United States Patent 7,700,838 (BACILLUS THURINGIENSIS CHROMOSOMAL GENOME SEQUENCES AND USES THEREOF) - sequence listing, part 3

SEQ ID NO: 4729 - DNA, 285 bp, Bacillus thuringiensis
gaagcacacgtcatatattacacagcggctacaacaacatcacgtggggataattcaacacatgaagctggcgatctatccataaatccactaagaaaatattcacctaacaacccaatagaagatacacttagatacattaaaattaattctccaagctcaaaaagcaaccactcacattaagatattacctctaccacgtgattctgtaaccgagcaagatcctttatttaatcacgtgcaggtacattaattctatccgcgaataccccttcaaaaaaaaaa

SEQ ID NO: 4730 - DNA, 130 bp, Bacillus thuringiensis
gcggcggtatcttggtatagtgtcacgaaataggccgcacacgtcaccgagcgtcgtgagacaacgctatcactagacaaaccctgtggggacccaagctaaccgccactcaatacaatcttcgtacgca

SEQ ID NO: 4731 - DNA, 311 bp, Bacillus thuringiensis
attcgtgatgaataaaagtatgcccgtttagaagccgaacttatttactaaaggcggaaaacgaattgctagggggaatctatacttatggaagggtggatgacaacgaaataacactaccactctattagaaatatatcttgattcgatttctcatcatcaaatataacctatggaatatatttatacatttaccttttgtagtttttctgcccattctcaacccttttaccactttccccccccattttcaagatcatttatatatcttttacccgttctcatatcaacctctttttatttttttaaac

SEQ ID NO: 4732 - DNA, 429 bp, Bacillus thuringiensis
tatcagacagtatgttggcagtgattgcgatttatggaacgatgaatgttgggggtaacactggactggtgcctgttacggagtagcacatcgccgcattgaacttttggaggcatcagcttgacattaatgtactagggcgcatgtgctatctgaaacatcagccgctacgccatgttactataccccgaatgtatgacagtggtattacgcaagagagtaaatgggctaattgtatagtgaacatagcataaagggacgccggaatgctgacccctagtgttcgtccatcagtgttccttgataagcaggcatcgcctttatttgaacgcctttatagcaatgagcgacgagatcagcatatagccttccctccgctgccatgcccgtctccccgttttgactcatatcaatcgactttaccgaagc

SEQ ID NO: 4733 - DNA, 160 bp, Bacillus thuringiensis
tattaggtttcgtcttgatactgcaggggctttttcgttttattcgactgggaataggaagactgggaggactacagtgacaccatcgtcctacatggtgatcttaatgaaattactatacataaagaactgtggacatgggttatgagtaccaacatct

SEQ ID NO: 4734 - DNA, 168 bp, Bacillus thuringiensis
agtgagtgatatctagagcactgtttccaatgcactattaatcgcatcaactggacaaaacaaaatatgtggacacagaggtgtaagcatcggacactcgatgaatggcagtgaagagaccgtcacagatgtgctgcgacgatgattgattagtcaatgcagtctgtg

SEQ ID NO: 4735 - DNA, 288 bp, Bacillus thuringiensis
ggttgaatggctaacattttcacaacacttgttccttgtcaagaactagaggtgtcacattaggatgaactgctttatgaactggtgcaggaacaagcctttgcactacaaccagaagacacatggtgcaaaaataactgcgaagaatcacgccccatgcgtggcactgatgacttaccaaaaaaaattacgatttgccatcaccatgaagaaaagtaaaaagccagcaattgcccgaagaaccggtgtcccgacgaactcttaaggtgtgttccaaccaactaaaat

SEQ ID NO: 4736 - DNA, 251 bp, Bacillus thuringiensis
gcatgagacgtatgcagcgctggcaatagaatctggtcgccatataaacacactcctaatatacgcttggggattttacaatatgatagatgagcttctactagcattcacacccttattaaagcacgaactattatctatgaagggccaaacgaccgcaactgaaacggaattggaaatatgaggaaagccgaaagggagtgtcccaggacctgtttatccacctcacgtgaccgctactttattaaccg

SEQ ID NO: 4737 - DNA, 130 bp, Bacillus thuringiensis
ttcgtgatttgtttaatacaatacatcgctctttctaactcccaatcctaacaaacctattccaatctacttagggggggatttataagtcatgatccccccccaaaacacaccctctcatcctattctc

SEQ ID NO: 4738 - DNA, 108 bp, Bacillus thuringiensis
ttcgtgattctggatgatcattcaaaataaaatatgccattttctttctaaaacgaaataaaaaaacctgcaagggggggctgctattatgcacacagccccgcatcc

SEQ ID NO: 4739 - DNA, 164 bp, Bacillus thuringiensis
gtgatctaacaaaaataggattggctatatagcttaccttcatccctccgtgtatttatagcatttttgtttcgaagaggccataagattgaagaaccaacaaatgtacctaagtctgattgtttatcaacttctgctttctaatctccccctccatctcccta

SEQ ID NO: 4740 - DNA, 277 bp, Bacillus thuringiensis
atttacacacacgatctgttgtatcttcaataacaggttttagaccaacctgataatcttgcattgcatgtggaaatccaaccgcaggacatgcatcttttgtagaggtagcacccagaaagatttctacttcttttctcaaatcgacttgcaaacctaccgctttcaaaaaggggtccacgatttttggccctaggtcttcccaaagagtaccggacattcttcccgccaagcgcattggctgtctggcgcacatacaacaccagcttaatgccat

SEQ ID NO: 4741 - DNA, 156 bp, Bacillus thuringiensis
ccatctggaccttttaatacggtatcgaatgccctggcttgtgatctggtaccagcttttaatgcaacggtggaataatgcagtgctgagactccactggaccaactcaagcattggtagatccgtggcggacattgtgatgatcaacgcactaca

SEQ ID NO: 4742 - DNA, 298 bp, Bacillus thuringiensis
gccggagcccatacaagtaggaacatttagagacgaattttattgcttcagtagagccactggcgcgattggtaatccatggggtgaaaacactgaagattgtgaacattcatgagcagatggccgcatatacgaaccaccgatacctacactacagtaaaggcatgccactaacatcattggaaagaataaagggctcacagagcatgcaaaggcggctaaccacacaataaatgaagcaatagttgttgtagttactgagattgccatcccgtatgtatcagaacctgtatgcaca

SEQ ID NO: 4743 - DNA, 151 bp, Bacillus thuringiensis
tatacaagccggacgcatatttcttcacgctggacctgactaatgagtgagtctaaatcacactagtctttaaaggattacttcaagctttccatacaaaaaaccgcatgacccatctttatttactacctattcaaatgtcggggagagg

SEQ ID NO: 4744 - DNA, 187 bp, Bacillus thuringiensis
gctttcctctcctgctgttccatggtgagaaagcagtgctgggacttcccttctttcagcagctgcagtgtgtccccatgaggaaatgtgtcaaagcagaggttttgcaggctaaaaatatatgaccaggttttcaaaatagcaatcacaaaccgttccacagcaatctgttttgtccatttaattc

SEQ ID NO: 4745 - DNA, 192 bp, Bacillus thuringiensis
catgttaaacggatttcatataaaagacccttgtttcagcaccctaaaaagcacctgtaagggcgagataaatatactcatccgtggcctaggacacaattcgccattgattagcgatttaacaaaactttgtccatgttgaggtcaataactctttagataatgcctaccaactacaggaaaaatcctacc

SEQ ID NO: 4746 - DNA, 129 bp, Bacillus thuringiensis
ttcgtgatatcctagcaaaatgtcgattccagatcggttacattactcgtaaaccaagcgaaccttcttgcacggatgaggacgagaagacattaccgccctatgagcggaagagagtgaaaaaaagtg

SEQ ID NO: 4747 - DNA, 164 bp, Bacillus thuringiensis
gatgagtattacaaatgatagcggtttcatattattacaaaaaaactctctggtaaacagcagaaaaagactcggaggggggggggtttttatactactatcgctcttatttaaacaagaacctgtcattacccttacgcaacagatacccacagagtcgatct

SEQ ID NO: 4748 - DNA, 252 bp, Bacillus thuringiensis
gggattggaaggccagaagacattactttattctagagagatgctcaagcagcggctaatagcagaggcagaacgacgatcatttgcagcaagaacgccggtgaatgcagcagaatacgggctacattgcgaaaagaataacgaccctgaaatggagaagtaaagcacgttagagctatggccaggaattagtacatagggaaaccacataccagataaggtgggagaatcgcttttcaaaaggtgcggttg

SEQ ID NO: 4749 - DNA, 132 bp, Bacillus thuringiensis
  unsure (1)...(132): unsure at all n locations
tcaatgtattagatacaccaaactctgggaatatttcctccgagaaataaagaactcgacttccctcagggangacacgaataaagatatcgccactcttcgcacgcaaacaggtatggtctttccagcacc

SEQ ID NO: 4750 - DNA, 162 bp, Bacillus thuringiensis
gaaccacggatcgccggccgatggcgcacgatccgatggtgggagacgcttatcttgaaaacatagaaagaccagatggagccagatgtgactgtgcatgcgcgattccagttttacttgccgattcattcaaagttccagctggatgcatttttgctgatc

SEQ ID NO: 4751 - DNA, 163 bp, Bacillus thuringiensis
agcaccaaaccagaaccccaaagggagcccactctttcttccaagacggagaaagccgacacacagggggagaaaggaagggaaaaaagcaccaggacagcacccaaagacacaagcgagcaaagcggaccccacaacaaaaaacgcccacaaaacgccgccc

SEQ ID NO: 4752 - DNA, 156 bp, Bacillus thuringiensis
gcgatccaccagctagcaaacgatttgcaaacggacaactattttcctcttacagttatgcaaactatttccgacagcaggggtttccatgtaacgatcacgagataaaaacactacgtcagggtaagggcggacactaagcaatagaaagaggga

SEQ ID NO: 4753 - DNA, 426 bp, Bacillus thuringiensis
tattaccaacaacagtatgctctggactgaatttaattgtcgagaccttacctgtcgagggtatcggtaaccaaagcataatcgatattgcaggagctgtaacaggagcatgtggaccaagtgatgctactggagagacttgactaacttgagatgcagcattaacaactgcgtctttatgaagagatgtgtgagaatcatcagcaacaccagtaacttttgctatgaactccacgtgagttgtttgttatatgtacattgatggaaatgggaaagcatacgacacgggatgatgcgaaatgacatctatatgacaaatgtagtggattgtttatgaggaggaattagcccgtatgacgctatgtgtgtggcaggaccaaaatatacatgatccaagcggataagatagatatatgaggaaggaca

SEQ ID NO: 4754 - DNA, 140 bp, Bacillus thuringiensis
tgatcttagtccacaggtggccgaaacatatagaatggctactatttgtggtacacatcgcactattaatagtgggggtgcacactcgctacgcgggggtatgagaaaagacggggcggggacttttgcaaaaagcactt

SEQ ID NO: 4755 - DNA, 151 bp, Bacillus thuringiensis
ttcgtatgttcgaaagcttaccgtatcgtgtgaaagtcttctcccagtatatgaggagtgtggcgggtgtgtgtttttttatttagacgataaagaacatttgaattaaaagtgtgatatccttgtacaagcatttgagaagtacatgaaa

SEQ ID NO: 4756 - DNA, 153 bp, Bacillus thuringiensis
gatcattagatcgttggtgatggtaacggatcaccaaggcctcgatgcgtagccgacctgagagggagatcggtgacactgggactgagacacggcccagactactacgggaggcatcagtagggaatcttaacgaatggacaaatgtatgac

SEQ ID NO: 4757 - DNA, 140 bp, Bacillus thuringiensis
gatttgagccatgttagaatacaatgcaaaatggcatggttactctgtattgtcgaatctaaaacattgggttgcagacaattatgttctcgatgtgggtctcacaataaagacgtttaaattcctatcctctgtaaatg

SEQ ID NO: 4758 - DNA, 148 bp, Bacillus thuringiensis
ctccctcttacccccttaagccagctggcgggggaaggtttaaataaaaacacaggggggttacccccaacagcgcagccagaatggaaaaaggaaaatggaagcaccaaaaacatttataaaaatcaagtgaaaacttttgaaaaca

SEQ ID NO: 4759 - DNA, 105 bp, Bacillus thuringiensis
  unsure (1)...(105): unsure at all n locations
ggatgcttgagatttgaaagcatatttatgatcaatttttttttagnaagagatacagacgtatgggggtattcattggacaaggcggggcaacaggtgctggag

SEQ ID NO: 4760 - DNA, 157 bp, Bacillus thuringiensis
agtcggataagtagaaaagcaaaagagtggcatgacaaatttctataaaaaagaagcccctgcaatccccgaggagtttcttacaatatattcaggaccgcatcgcaagatcagtagacgaatgcggtgtcaaaatatcaacatcaatacggtgcat

SEQ ID NO: 4761 - DNA, 283 bp, Bacillus thuringiensis
aatgagaagtcagacatgttttgtatgtcgtaatggaacgatgattttttattttttctcccccccttttatcaagctctcaggagcgggttacctctctcttttaacgctctttctgaccgccttaaacttctcctccttacttttaaaccgaaagcgacatatctcaaatacatttcatatgttttaaagagacgcatcgtgccgcaaagaacgaaaccccaccttgccctgtatattcaacgtgaattgttttgtcagaatctctccccattcaaaatga

SEQ ID NO: 4762 - DNA, 245 bp, Bacillus thuringiensis
attaccagttattttacccccatttggagctggtactatctgttattgactaggggctacttcattaggctctcctttgttatgctcttcctatttaggctgctgctacctgagcttgaccaccattgttcgctggagcaactaggtctgcgggtgctagtgctggtatgagcatatccaattatagaatgttgataatgaattgtttcagagcattaatcgacttaggctactcctagcatgac

SEQ ID NO: 4763 - DNA, 155 bp, Bacillus thuringiensis
ttttgtcgtacatatagcctttccaacaatcggaacgcgtttatcatttatgaatgctcataagcgaagcctttttagtttccggattgactgcggcatccagtattgtgtctgtacgtccatcacgaccatatatcgcattattttatattccc

SEQ ID NO: 4764 - DNA, 439 bp, Bacillus thuringiensis
gttccaccacgtttttctaccaaacaacggatgacacacaggcaacatgtccgacgcaccatcacattacgacattggactaagtgcccaagcccattacaaaaatgcaacggttgcccaaattcctagttcatcgaactgacgcaaaagtaacatccaaagaaacctgctgaggccgcctggaccctccgtcgtactctgttctactgactatggacatagtcttattacatttgcactgatatgttttaaaacctatagcatagctttatttatatataagagaggaaagtagaactaagagagtgagaaatcacgtatgcgttccatttggaaaaagcctttaccaagagccttttttcagcgtcatcaaaatttttgaaaaaggcataaccctatgggctggctatatgaaaaaaatcacttttccaatttttag

SEQ ID NO: 4765 - DNA, 224 bp, Bacillus thuringiensis
tcatatagaccagacgatacgaatgcaaactcccactgggaccacttacaatttcaaagcaatattgtgcaaacgccgaattctcaattcgaatcttagtccagacagaagagtttctatgctttaccatgtggcgatccgttttcaatatccatggatctaataccatctggaaaagtaacttccgacaactttggaaatcggacttaaaaatacgaggattc

SEQ ID NO: 4766 - DNA, 160 bp, Bacillus thuringiensis
gacagtgtacaggaaaatgcattccatcctggtacaataagccgagttcccttttgagctggctgcactcactactgaacacggaggaggacttctctacaggatgaacaaattgataaacctagacggagcaaacgctgatcaagcccaataagacgca

SEQ ID NO: 4767 - DNA, 226 bp, Bacillus thuringiensis
cagaccagcacgatataagcaaaccgcaacagctaatccagggggaaggtataaaagcgcacacgcggggccaacggcataccaaaaacagaggtgaaagaaaaaggagtgacagcccaagctcgacacagcggtgaaaccacggagttcagagcggacacaaggctggcgtactcgggagggcaagcgaatgcgcaaaggagtggttcagagagcacagactgcg

SEQ ID NO: 4768 - DNA, 173 bp, Bacillus thuringiensis
aacagaaagggagaagagagaagaagaaagaaagaaagagaaaaaaaaattattaaaagaggaagaagggaagaaaacgaggggggggggaaaagaagaaaaagaagagggagaaaaaatgaaaaaaaaaaggagggaaaaaggaaaataaagtaggagggaaaaaaaaggaa

SEQ ID NO: 4769 - DNA, 462 bp, Bacillus thuringiensis
taaacaaacttctggtcctggtcgtcctgatatgaattaaaagccactatgttggatgctggaggcgagcgctttgcctgcattatatgaccataaatgctagaggtgagtcgttgcgccactgagcgttggagcttgttgaatggatcgagggatcgtaatgtgaacctgaatatctgcgccgtatgagccgtttgcagactctacagcctagcggtccaagcgggggattgcgagcccctcaagatactaccaactctttttctgctgattgaggcacaagcacatctccaataccaatatctgcacctgttgtgaaagcgtatttaggcctatcgtataagaactgtgatgcactcgcatgataccatggtctggttacactgtaaccagaggctgatgccaggggggatttgtctagactaacctggaaggtctctatacaatagtgaccggacttag

SEQ ID NO: 4770 - DNA, 201 bp, Bacillus thuringiensis
cttttatgccgctactatgggcctttttgatatgtttgtctgatttcatggcaattgcgctacaactaccgtgattggctcgagaaataaatcccgattccgcctcattaacatgcacgtcgggggtttggctgatcatacgggctctgcagattccaacgatggtaccgcttcactttgagacccgatcaatgaaagtat

SEQ ID NO: 4771 - DNA, 157 bp, Bacillus thuringiensis
ccctgaacgcctacccctaatgtcatggctgggcctgcttgtccatttttcacatgacgatagtcggcaagcatactatataaaacctcttcgcttccctgaaacgcttcttgctcaacctcataacaacggtgcaataaaattggcgtgggctaca

SEQ ID NO: 4772 - DNA, 119 bp, Bacillus thuringiensis
caatggggctgcttgcatggagggtcataggttaaatgcccagcgttgttcccgagaaaaaggaatcattcgactgatataacctgacgaacgcttaaaagctatcactgcccatgtat

SEQ ID NO: 4773 - DNA, 136 bp, Bacillus thuringiensis
taatggatatggaagtccacgcagatggttataatattaaaaggaagggcatatggttctgaccggccaggagttcatgtggctattatgaatcataactatgatgaggctttcaccactatatgctttaagtgag

SEQ ID NO: 4774 - DNA, 201 bp, Bacillus thuringiensis
tttgtcttacggcaaaattataaagtggagctttatttctactgcaacacgagtaacattagtcaggtgatttcacatctactactataaaaaaagcggaggacgaatcttctacatcccaatcatctaaaataacaagttatccctttctatcagttggtacattaattgcatgtgtaaaattatatgatgcggcctaac

SEQ ID NO: 4775 - DNA, 356 bp, Bacillus thuringiensis
cgccagccaagtatatttcacgctcgataccgatgattttccagtagcgctctactgcattaggttctccagctgggatcagaaaatgcatgacttctaagtcggttactactatcacatcattatgggagtcattcggaacacctagtgatgcttttcgttgcaatagtggacgatattcgctgggaggatcattcctagctgtaatacggattgtatctttagcacctccaatgagttccttactttgccctcgtatagatgattgcctttctacgctccacacacggtcacatgaaaaggatcattccgatgtgtttgcttcccgtttattacttcttgattcggattcctgt

SEQ ID NO: 4776 - DNA, 122 bp, Bacillus thuringiensis
ccaaatcgggaataaatctactggactagggccccacctccgatcaattttgtctacacgccagtatgaggagcatacggggaaatttcacagcctttataagccacatgatacactgcaaa

SEQ ID NO: 4777 - DNA, 114 bp, Bacillus thuringiensis
tagacactttaaaaatgttagatacagacattgatttcaaacacttctatccgacaaaatgatttgtggcccttatacagcctggagtatgcctgcctcttcgcaacttagaaa

SEQ ID NO: 4778 - DNA, 348 bp, Bacillus thuringiensis
  unsure (1)...(348): unsure at all n locations
tgtatcatgaatgactacatgcacctcactcaaccctacgcaattgcgaatgcagaggctgcattgcttggagctattcttgcgccttatcaagccttaagcggtcatgatgctacatatcatcagagacgcgtacctgaacatggactggctctaaaaggactatcgattttcttgactaaataccgtccgtgtattttaatgctgccgatacccatacatgatatatctaccatgatgntaacgtaatgtgatagacaagcataccagggcataatacgttagcccagatttgtacggactgtactagcgctgatatcaccagcatagtaaatcaaaactcttctt

SEQ ID NO: 4779 - DNA, 133 bp, Bacillus thuringiensis
caagttaatcctactgacataatggatggtaaaattcccattgtcttattaaatccgggttttaaatttaatgcaaggtttgtcataatgctcggagcagactatgatacctctatcgcatcttgccaagaac

SEQ ID NO: 4780 - DNA, 120 bp, Bacillus thuringiensis
catatgggtacgaagcctgtttacaatttcagcggcaggtgctacatgtgcatcctttattgggggcgaaagcgcttggtgcattctttaatgatgatttaatgggctggtcaaagaata

SEQ ID NO: 4781 - DNA, 388 bp, Bacillus thuringiensis
atcgtacgcggtttcgttaccagacgataaaggagacgtaaaacctatgacgtttatacattaaaaccagctcatttaatagatgcagtggtgcccataccaacacaatggtttgtagctaaaaacgaaattaccagacgcattatcccgactcctctgtgagaaaccccgacgtggtcccctgatattacccatcatgctggtaatacaagaaaaaggacaatgccatgatgagatttgtccaatcccattaaattagtatgggaaagcgtttatatcgaacaattgggtggtcattccctatgactatttaaagaaatgctgccagaatggaagacgcaacagtaggggttacgaatagttagttggccctgggaacagctgccgt

SEQ ID NO: 4782 - DNA, 186 bp, Bacillus thuringiensis
catgcacataacacgacactcagtcagagtattatctgtatccgtagcatctatctgcgcttacgtagtgttaccgtggaaatcacgatattttacacaacctgagacctgtagatgattcatatttgtacaacccaacaaccggtatagatgctcatactgcggtataatggagataagtgctat

SEQ ID NO: 4783 - DNA, 163 bp, Bacillus thuringiensis
aataatataaagtttttaaatgtgtaaaacctatatacattggatttgagtgggaaatacagcactcctatcagaaacgaagaacataataagattgatttcgccgtgagcggaaataatgaaaacaaagtaaacgtacaactcgccccaatatgtgaagaac

SEQ ID NO: 4784 - DNA, 100 bp, Bacillus thuringiensis
agattgcgatacattcttttcttgtaacgattgcaccggagcatcttcccgtaaaaggaagtgaacatcgatctgtgctccttacaatggaaacaacaca

SEQ ID NO: 4785 - DNA, 104 bp, Bacillus thuringiensis
aagggtatgtgaattccaaacaatatgattttgagacatttgatgaaacaccaacaaggactggagatatggcttgagaggccgcacaccgctctcatgacgaa

SEQ ID NO: 4786 - DNA, 226 bp, Bacillus thuringiensis
ctttggtgattctaaccaactggctgagcttagtatacttttgacttatcacataacccgaatctaacgagccatagagaaagactgactctgatcggtacgatatccaataacactaatcaattttagaccctagcggacggtatgctataacgatcaaggaggtggacggatacccgggaaagctcccgtcactatccagcggtctatttgtggatccttcttt

SEQ ID NO: 4787 - DNA, 396 bp, Bacillus thuringiensis
acttaaagctagtcccgtacttttagaaataaatatctctttactttcgttactatcgactggatgagatcttttttctggactttgtgatgaccgtacaaatgccacaccttgttcatcatattctgcaacaaatacaaattgaggtggcgctaaatgtacaatattattagacattgcgtgtacgcgcatgctaggtaagaaaaccatattcggtaacacgatatcctgattacatatacgatgtattgcgctagcagattgtattgctactgcattaacgctgactcaaatatgtacattctcgctataattaacatgatctttgtcagtgggatactctagactcgctcttgggtggccagcatacttgtaaagctagatgtcaaaacaaca

SEQ ID NO: 4788 - DNA, 266 bp, Bacillus thuringiensis
tggggatggagtttgtttcaacgagccctttgcaactagaaagggggtaggagacatcgttactgaggcatttcatacaatggccaggtgagcctgctcgcgcttcgtacttgagggtagtacgcaaggttctttcggatgatcggtaacgaagaacttgcgagacatgaccaacatatggatattgcagggaacggtgggctgggatattacacggctatatgcggcaggtttattggttataactaagtggattttcctaaaaa

SEQ ID NO: 4789 - DNA, 406 bp, Bacillus thuringiensis
cttctgctgaagactttttttgggacgcattagcttttgttcaacaatcagagaagcctactgttccgcggcccgataaaaaagtggccaataaatattgagagcctccatagacaacggaatcagctactaacgtatatggctcattggatacaaaccataaaatagcatcgagcttcaccatgtgagacaactattcaatcagtatgacaggaggacgcatttggcacatattacacagcaaactctgcaggattaagagccatttgagacggtactcgaaaccactataacagaacatcaatcctacgtacaagatttcagagcaagacatgacaaaaaaggcaaaaactacgatcctctgaacaatttaatatctgttgaaaaaagatacttcaacgcatat

SEQ ID NO: 4790 - DNA, 167 bp, Bacillus thuringiensis
tatggcgaagcttgcttaccaactacatatacatgatatgctttattctctaaacacttcgaatagaagcgcttagggcgctcttcagacatggttacccgtacaatcatcatgtttgagctctcaattgcgcggtcttttccccttattatacaaaaggctcattc

SEQ ID NO: 4791 - DNA, 362 bp, Bacillus thuringiensis
cggcgccctctctgacgaggacctctgactttctctagttctgcagtcgtagaaacaacctgcgcgcgtccagcactgaattcgacgcacgtccatctactgacggctgctttagccggcgatttattcgcagcctccctccttgggctgctctctgcagctcctagtctatcttgaagcgcatcatgatatactcctctcacgcgtccagctggatgataatctagaagccgacgtctttcttgccattgcttttcacacgctataactttttcacatggttcacataactgctattcggatttgacctgattacaagatcacctacgaaatccattctggaataactgcattaaaaaact

SEQ ID NO: 4792 - DNA, 368 bp, Bacillus thuringiensis
actccgcttgctgtgcacgatgtacccactcaatattctgggcattggttttaacaccgagtggtccacgaagatgtaacagagaagggctctcttctaatcgaagacggactggatagcggtataattgttcagaataccgcatgaaacgatatgcgctttcgtcgccataaaaaaatgctctgcagataaaacagctttgagttcatcatattagatggactctcggtatactgtatacctataggggataataccatgtcccctctattttgatcaagaaatgctataatcagaggaggacgggctcatacgctcattatgagctcacaccaaacgggattaaagaaaggtgaatgagaggagga

SEQ ID NO: 4793 - DNA, 363 bp, Bacillus thuringiensis
tgaacctcttgccctttaacatgggcaagagctattttttcatccttactgagtagcgagtaggtgcggggatcatgactcaaatcataccgctactgaacgcttgcttgatagttacgcacagatgttcactgcacaaacacattgggatatgtgtgttcaaagtcatgctccatacgaacaccatcgtcgtgatcgtcaataggtttctgatgctatgcagtaacagagggggcccttactggtccccttgtatgtctctcgccgatacacttttacacatccttccattactcggaattcgctgatgtaccatacatacacgttcattggctcatcaagttgcttgattaagtgccttag

SEQ ID NO: 4794 - DNA, 360 bp, Bacillus thuringiensis
aaaacaccgcttttttttttgaaccaaacagtccacccaacagcggggttttaatactcagtctcccgtgaaacgaactctttagaaacccattgttggaaccaaaacctgaatacacatatcaactagcgcttgacctgtcacattcaatagtctcgattctgaatgcgaaccgaagttatataaaacatggaacaatccattgcatgaaaattagtataaactccctgccaactatatctaaaggaaatcctgttgattcacgttctattacgattctaccgaaaagtccacattttgtgattaagtgtaatctaacggctcataagattccaatgttgatgtacaactaaaaaaatt

SEQ ID NO: 4795 - DNA, 436 bp, Bacillus thuringiensis
ggcttcaaaatgtttgcccccaattcaaaataaaaaccgtttttttcccaataaaacccataaagggctgtggtgggttttagcgaacccttagggcctttaaaattttcatttaaaaccggaaccgaaacctttaccaaggggagataaaccgttccagccctttttagggggttaaaaacgggcaaaacaccatttcaatggggaatttcacttgggccgtgataaaaacctggaaccgcaattaaaggattttttattccaaaaccaaaaaggggccgaacccgtccgttttttgaataaggcggtggaacttttaaattttcaaaattgttttttggaaaattaaacctttccacgaggcaaaaggatcccgcttttccttgaccttttcccgttttaaaccgataaattaatttttggaattcttcaaaaa

SEQ ID NO: 4796 - DNA, 372 bp, Bacillus thuringiensis
gaaacccttttgaataaggcgctatatatgtttttttgctgtgacatgagaaaggctaagctgagtggcatctataccaattgatgtatctttctcacgaggaactatttgtagattactaattgtttggggggaaagagcgtcctcgtatacgaatcgtatgtgatgataaatgctctcacaatgatgattaagagatgatcatagtaatgaagccccttttttatatcaggagaggggagaaatactatggtggtttagaaataaaagcctattgttatggatcagaaatgttgtggaagcgtatttataatgacaaatactgtaatctttgagggaaggggttcatttagctcgtgagaggatcgtagt

SEQ ID NO: 4797 - DNA, 309 bp, Bacillus thuringiensis
atctattggagaccatctgtgagtgattaggtcccattttttttgacctgaccgaaacgcatgttacgcgggggggccactacgctctgtggagtttgtgagacgccctgatgaggagcccgggcgcttagtcggtatacacacattgatggcggtcaagttgatgacattggctggacatgttttccagagggcccggccgcggtgggataatgattgcgacacgcacacgcgcgctagtgtgggcgttatgttacatgctttgagagcatactgtgggtattcaagcacggggggctacaactctat

SEQ ID NO: 4798 - DNA, 364 bp, Bacillus thuringiensis
catgattagttttaatagcctcaagaacataggacactgcaggagtttcatgatggctctcctatactgatccttctcataaagaggtacacttccttgatgcaaagcgaaagacattgaaccaagtcgctcgggatacaggagatttcttaacatgccctgatgaaactttaaccgatgaacagaatcctgaggactttccccatctaaaaacccctcaatcatgcgctgcaatcgtacttcgcgtttctacaggaaattgaagctgtaaaaattttactgcttgaaaaagggagcagcctcagtcagtaagtggcctaaacgtagcaacaatactacttgatcacttaaactccaagtggtg

SEQ ID NO: 4799 - DNA, 264 bp, Bacillus thuringiensis
tgaaatataagaccgaatataattccgacttttatttcaggaaatacacgattattaacggatacttactgacaacgcgtatggtacaatacgccaaactagatgagcatgactgaagcgataatgccgacaagcattgtatccatgttgatcccccataactccaatctgttatatagaatataaggcaataaaacccataagtaaactaggaaattccggaatcaaaagaagatgggaaaatgccatcttttaatgaccagc

SEQ ID NO: 4800 - DNA, 432 bp, Bacillus thuringiensis
gatgttggattttcttactcgtatatggcctctttctaaggggcggacggtacttatttatccgaactgataaacaggataagattgtttacgataggagcctctaattgaacggacagtggagttgcaggaatggctttgatctgcattggccctatattatgaagatacaggacaatgccgtataccagcgactggtgactaactgctggaaatacctgattctcattatacacgtgacatatatcgagcggcgaaaattgaagtaggagccactttagattaggcttacatatgatagatgttcaaatgtgtattgcttatgaggcatcacaaaaagatactcccataaatcgaggatacactattgtgcgagcttctgctttgattggtaaaacgctcacggtctataatgaggaatttctaattttt

SEQ ID NO: 4801 - DNA, 333 bp, Bacillus thuringiensis
agcctgccttggctaagcatgcttgccgactacatacagatcggctttattttttttcgagcacattgattgagatctcggggggggtactctggaatggggtcacgaacaatgctgaaatgtttgagctattcaacccaaatccttacacacagtgtggaatttgcccagtctctttctcaaagactaaaacacacggaaccaggttaacgtgcccgttggctatcgcctcccgatttttttatgcaatgtttggttttttcacggttttgcagcagttatcaaattcgtctggcaactgcaggaacacctagcatgtaaaccttcctttat

SEQ ID NO: 4802 - DNA, 142 bp, Bacillus thuringiensis
gcttacatatccatcagcccgacctgtcattcttaaccgttttcgctcgatttgcgcccatccctggtagccacaaggtatcaccactaaccgctgtcaccggaatcataacccgctgtccatggcttgcaccccttgcctc

SEQ ID NO: 4803 - DNA, 391 bp, Bacillus thuringiensis
tgcactacttttaataatagtgcatataaatgctttattggggatttctgaagcatacccggggaatcctattctacgatccaatgtaaacggtgttccaaattcagcaatcggttttacgacaatgagctatcacccatacatacttgaactaatacgaatatgattttttaggcgatgaaaaacttccggcatgaaccggtgcagatttttatttactactccaaatctgaggaaccgtgtatttcatcatgcaatatatgcatgcgcatagatgcagagtcaatttggaaacccttcatacaaacctaaaatacgttgaccaacctgagttccgccatggaaagcactgaaaaaaaatgcaggttcaactgttatactgggaaagagc

SEQ ID NO: 4804 - DNA, 410 bp, Bacillus thuringiensis
aattccctaacccttcttttttggatttaaaccctctttaaaaggggcgtgcccaaaaaaaggggggtgggaaaaagggttttttttaacccttacaaggttttggaaaaaggtttttaaacccttaaccttcttcccgccggtttaggcccttattttggtaaccttaccatggaaaaccttttggttatcctttgtggaaccctgccagggcctttaatccttaaaaaacccctttttggctacccgcccattgggggttccatatcccaatttaccagttttccttggaaaataccggccggagggcccccggttgaaaaaggtttagggtgttttaagatgggtttttgccctacttttggaatttccccccaggcccctctttaaaaaaactctaagggaaaaaa

SEQ ID NO: 4805 - DNA, 358 bp, Bacillus thuringiensis
ccaaaacgcgagatgtcgccccttcccataaggggaaaccaacgaatcgttttgctattatagacggttttggtaaaactgtcaacttataggtcttgaaacggacatgatggtggcgggctggtgactagaatgcactagcttatattgtatgtattatcagatcatgcattacatggaataagcgtactatttatgtgcataataggaaggatttaacttgtaacgcaaaaaaacgcatatcggtctggacacccgtattaaaaatacccagttctatcgcgcacctcttttaaaccatcaaccgatactcggacacgctgtgaatgaacgaatcccacgttcacataggaagcgt

SEQ ID NO: 4806 - DNA, 133 bp, Bacillus thuringiensis
cgtgtcgacacagacagatcccaggcgttatcgatctccaaaagcacgcaacgcatccggggggatttagatagcgcttcggcgacgagaccctccccgcccgacccaccaaacaggcgtgcagacggaacgg

SEQ ID NO: 4807 - DNA, 220 bp, Bacillus thuringiensis
tatcagcgcgctttttcatccaccttataccagacaaaagggggggccttatcaaaactaattactgaatccctaccaaaacggaaagtgaaacaaacaagccccctaaactttacctatagcgacgtctagtgagagccttgccgtaaatcaacggataaaaaccgtttacctgagcaaaaatgacctattccggatcaacaaaatgcacacaacaata

SEQ ID NO: 4808 - DNA, 133 bp, Bacillus thuringiensis
caccaagctgcttctacctatttaagctgtttgcacccttttcttgctcatcattttttggattaaccgctttagaaaactgaaaaggaaattgtgggattttaattttcattcttaataccgccttcaattg

SEQ ID NO: 4809 - DNA, 361 bp, Bacillus thuringiensis
ccccacacgttggttgtagctcgccgccgctggcgaaggaggttggccaacaaataaaaaaaaggtttcttttttaaaaataaaatttctctctggtgggggggcggaaaaaaaagggcccccacttgtttccgttttggggccctttttaaaaccccacccaacccctttggaaagggttttgctcccaaacttttaaaaggggggtttaaaaaggggggtaaaggtggttttttttgccaaaacccaatttattttgggggaaaacttccttaaggaatgctccccagccaaaatgccaaatttctgaacggggatttcccgctttatataaaggccttcggccccttttggggcggtt

SEQ ID NO: 4810 - DNA, 247 bp, Bacillus thuringiensis
cacaattcactggcctttatccaacagcgatgtgctgacacgtgcgcgcacgttatgaactaaatgcatactgtatgacgcccgataaggctaggaaaggaccatgcttcactacacttgaaaggcgctcatattaccgttttacattgggtgctcctattgtgtcatcgggacataccacgctaccaaagcataatatgatggatacttagtgtggcccctaaagcgagtgccatattccatgatt

SEQ ID NO: 4811 - DNA, 174 bp, Bacillus thuringiensis
tgcttgactcttcgctacaataccatcccaactctcagtgatcattcgacgtttggatcacggtccttctattaatggtaatgcgtttgtcctaagacgattttttcaaccctattgaattcagcttgatgaacattcataatggtatctaatgtcacttacttttgttacacc

SEQ ID NO: 4812 - DNA, 348 bp, Bacillus thuringiensis
gacacaacgtttttttcttcacccgttgaacaacgctactgggtagtgctacatttgcagggggaaacgggttgggtttacggactgaaatgattgcacggcccctgagtagacgacaggttactgtgcaacatattcttgatctcccggatcgtccatcatccagatgtccccaccgcatggtgaggcgaacagagatgagcattacaccgtgcttcgtattaccagcagtttgtgtcattgcactgtttattataattgcagagagtataaaggtactactagaacgatattcgtctatagtagaggatgtacccactgtgcttatattctgctcacttcgatgtc

SEQ ID NO: 4813 - DNA, 252 bp, Bacillus thuringiensis
tatagacggattgttacgtgtaagcaaacaactcacctaccggtttattacacactcgtagcagcacctgtagcgtattaaataatatacaatttcatgcaggtagacgtgataatccttatttgtttgcgctcgacaacggtattcatagggatcggaggatgaataagaatcgtgattgtttatttgtgagtgcaagcatgggaaagcaacctgcttgtgtacctggagcgacactatcaagtgtagttg

SEQ ID NO: 4814 - DNA, 240 bp, Bacillus thuringiensis
cctttatccacatgcatgtttgttggacaacctgtacctgtcgcgcgctgtggagaatgatttgccgctaatgaaggacaagcgtacgcacttgaaaacgatgtttctgattacaaacgaaacagggatggaaatgcaccgggctctgtttaccatgaaatattatttatgagccataggctcatcatgaatgtgcgattgatcttgttacggcggtgaaagggaaagcgcttattcaag

SEQ ID NO: 4815 - DNA, 150 bp, Bacillus thuringiensis
taaccagcgacacagcctttctcaaagcatatcatcaagaggagtaaaactctggtgcaccacgcattgatagttagagcttatctgatatggaactagaaggagttatgccattctttacggtgcttcaggaagaactacaagctggac

SEQ ID NO: 4816 - DNA, 214 bp, Bacillus thuringiensis
acgagcgagaagtctcttttgaatacgagacactaatcgtcaaaggagaagttccattagtcgctgtatcccagataaacagtggcgccctatcccgtatggaatgcgcgtaaagcgacagagaaagccacactgacagtgatgattctggtcaagctctcacacaaagacagtccaaaataagaatctcttcttaaaggaggacacaaatggg

SEQ ID NO: 4817 - DNA, 124 bp, Bacillus thuringiensis
cgattataaaaaaacctctctttttttgacccaaaaccacatgccaaggcggaggcattttttgggagtaaatatactcaacgtccaattacaatgcatgcactgcattaggtaaataactgga

SEQ ID NO: 4818 - DNA, 178 bp, Bacillus thuringiensis
ggcagatcgtgatagcattgcgcctacacaggcatatagacgaatgaaacggatgatcacattactgttagtgggttagcatctacaggatgcgctctggcgtttgcctcacttgcaatggatggcttatggagatgcgatgagcacgcagacgggactccaccgttcaatttacagg

SEQ ID NO: 4819 - DNA, 464 bp, Bacillus thuringiensis
ggtccttgatacatacctacgatgggaacgctcactctttttgtgccatgacggtcgaccgctgcgtctctgaaccaagtgactgagtcacgttgtatgtttctactggcgcgtaggaagcatataactcaccaacagccaagcgcttcaagtctaccatttaatcaaaatacaccccgactatatacaacccctcttgatattgcgacgctctgttcgatgtacaccatacagcttcgctagtgctctatcacagaacttgctgtgctgcgcgagacgcattgcctcttcaacacgctctgtctgctcagctgcggatacagctagcccttgcattcctaaaccggtattccgctctactgctctattgtgggcatagtgcgtaatgcgggaacactgcgttcatatgacacttacatggtcgaatatcgtcaattctcactccagctaatccatgcttccct

SEQ ID NO: 4820 - DNA, 198 bp, Bacillus thuringiensis
cattgaaaccggagcgctttattctatctaagatctggttgaataccgggggtgctgtattgaaattctaacctacgggtccttattaccctggagacagtgtcaggtggacatttagactggggcggtcggtaccttaagtgtaacggaagtttccttaggttccctcaaatatttttgtaaattcattcttatgtt

SEQ ID NO: 4821 - DNA, 494 bp, Bacillus thuringiensis
ggagagtatcgcatggtcgcaggacctctactagcgctttttgcgaggtggtcctatggcgacgagtaagtggcagaacttaaactacggtcgtacatagccgaaaatgagtgttaacctaccaattttgacttgaatcccgacgagtttctgacactccctgttataaaaaacgactccatcatcaatgatgggggggatggatcccaccttacgagtgccccggtactatagatgccagagcttatcagctatggctgcaaagaatctcatttacgagaacgggacttgaattgaaccatcccacattatgatcgcactgtcgcaattatgaacatacccgcgtaagactgctacaatacgcttaaagaaactattatgtagggcttccatggcggcgccagatggctgatagtttctgatattacccatgtggacgtagtctgagcaatctgcatagtgcggaccgggcactgtattactgagtacatgcc

SEQ ID NO: 4822 - DNA, 326 bp, Bacillus thuringiensis
ttatagtcctgtcatgtttttcaacataacattaaatcgttaatgcgtgaattgatgaaatctcgacgattacagctctataatttactgttaaaccaaactatgtccccaaaaaaattatttaaagcttggtattcttaaagtccatttctgttattgggaggaatacaaatcaatgcgtatacggtacaaaataactatcgtggctcatccaaggaaatttatttggtgaaaaattgcttgtcgaataatatacttaagtcgtttttataccttttcacccttatttattgatgcataatatgcctaccacgtcaataatattt

SEQ ID NO: 4823 - DNA, 468 bp, Bacillus thuringiensis
tgagtggtgacagataaaaaacatgcagcaggtgtttgctgactcaacgtcgccggcacaaaagacttagctgaggcaggcctaccccctaaacatggctaaccttctacatggataggaccttgctttgaacgtacaggagtttgggacaaggtctaattccctgcacctgtcaatgaatgggctgaatatggctcactcacatattgtggatgatccatgtatagaatctctacacatttgtacattggatagtcgaaacgcatgatgcatacggcgcaaatacgagtgtgtggcgatacataccatctacaacgtgccataacgggacttgaagctcaaggattgatatatggagcatatccagaacccaaaggcagtccatgcgctttagcaccaatagttgaaacgccgattgcaaacaaacacattatatatggagataattcattgatgcgttggcacact

SEQ ID NO: 4824 - DNA, 204 bp, Bacillus thuringiensis
gcactagcaatagacattagggggaggatattgcactttttataacgcatgatcgccctatcagaaccaggccatagaagggcagcagtcgttaaattaagttttctatctcatatacacgttgtaagatcgcatattgaatctaaggaccaacgccagtcaagccagtcacgccctgcttgaattcactatgtgctaacaaca

SEQ ID NO: 4825 - DNA, 354 bp, Bacillus thuringiensis
caatgaactagcagggctgtctggtggtatccgatctatacttgcttcacttgcactgattgtaactagaaccgtacgacataatcctgagcgacttggacatgccgtgccttctttcttggtattgactggcatcactgcaaggagggctgcttctgtatatggagtgcctgccgctgtggatcacttagattgtcgagcacttctatggctgctggatgttaggagcacgcgctgatctaccgattggcgcacaagctgctagctatgagcgagcgctaggagatccgacttgtcctgcgacgctctgctgactcagggtactgcgctctgtggccatactatcgttgagct

SEQ ID NO: 4826 - DNA, 138 bp, Bacillus thuringiensis
cgagaagctagcctgcgaacgcatatagattaaccagagcggttttatctctttatgcagcaaactttgaaaaacagtggggggatggagaattaacaaactggctagatgagtaccgagctggtcgcacaccaaacg

SEQ ID NO: 4827 - DNA, 269 bp, Bacillus thuringiensis
gtaactcggtaactcccgctgtctgagcgcctctacactcttcttccatacagtgaacacggggacctgctaagacaggggagattggcatatcagcgccatctcctggcgttaaagcctactaggagctatcaatatcatctgtaatagactttgcactaaatacaaaatgagcccaccggatagactacctgattcatcaatcggccccatagtatacaaaacggggacactgtgtccactgcgtgactctactactacacatatgt

SEQ ID NO: 4828 - DNA, 292 bp, Bacillus thuringiensis
ccaattcgtgatgaatcatagaacagctctagcgtgatgattatttcttatatcccccgaggatcgatcacctcaaggggccggttcaacaagggatcggaatgctttatgctaaaaagataaaataagcatcatttgcaattatctcatataaaacatcccctaaatatagctgtaatcgagaccttaaggagtctacaagcccccaaaatatcactttgatagatattcccgcaaccttttctaacaataactgcattatatccaactgagacccctaacttaaagaagt

SEQ ID NO: 4829 - DNA, 327 bp, Bacillus thuringiensis
gctctacaatagattgtaattttcctgctggatggtcttattctatagccgacgctttcaatacgtttcgggctacttcggaacctgacattgggcgactacctctctctcactcaacaagaacgtgagcaagtgcatgttgaccttgtggaatcgatcgcctgcgataatctgacaatccacattctaatcctaagattctaagaatcgcatagaatatcggctcaccactaccagaacctgttactgcatcatcagattcgtctacttaccaacccttcagcacaaccgttgcgcattgagtactctttgatacgaaacgcactt

SEQ ID NO: 4830 - DNA, 226 bp, Bacillus thuringiensis
catcagaaagtctctgcacttttaatgggaaggaatttttttttccagaaaagcaccactacagcatagagagctccggtactccatctccgccatccaaagcggcactttcgcagagtaatgcttatcgtacacagtgggggaatattcatcagcgtataaacacgtgctcgaatggaagcttgactagagatcccaacccgggagttgagaacccatacagcca

SEQ ID NO: 4831 - DNA, 141 bp, Bacillus thuringiensis
ctaaaatagcacatgatgcttaagctgaaacagggcgaaatttttttttaggccgacgctggcaagacgaagcgggcgactttgcaagacgacatggggcaacgacatacctgatatccctcaactaacctaactcaactg

SEQ ID NO: 4832 - DNA, 259 bp, Bacillus thuringiensis
aagcctacctgaaggaccttgttggaatgaaaaaaagccactgctatatcgggcagatattacggatagaaaatgatgcatatacaatcatacctctcatacccaccgagtaatgtgactcattcaacacatcggctgagtcagatccatgtttagaagctggactactcttaactctggaagacggctctgattctattactatggatgccgcaaaactggcgcacatttgtgaccctgaaccaccactaattgaaaa

SEQ ID NO: 4833 - DNA, 253 bp, Bacillus thuringiensis
acacatgcagtgcatcgattttttacattacttacaaaccaagaaaacgatgggcatggagtgacgttgaacaaagggaaacgacccaaggcgctgggtccctcaagaaaaacactggctgttagtataccacggtaagcacggtaattggacatggatctaatagaatatcaagcgctattacctaatgagtttcgatacttagcaaaaagcaactatgaagtaatgcagatgattgaacagtataccagtg

SEQ ID NO: 4834 - DNA, 103 bp, Bacillus thuringiensis
agatactacgtatcactcttctttgcgaaatggaatctacaaacggggggggatctctcaatggggctaacgccatacttattggcaccgctaagatctggaa

SEQ ID NO: 4835 - DNA, 158 bp, Bacillus thuringiensis
caatgagttggactgaagctgattttttttgcgggctagcttttgaaaggggtgcggggtacttgactggcataggtgaccacccaacacccgcaacaggtttgcttttctttaacacttcaccattattagaaaaaccagggttagaaattagacat

SEQ ID NO: 4836 - DNA, 256 bp, Bacillus thuringiensis
caatgataccgcggtctattacaacgcaccgaaacatttcttttcgagcagttagcagaccaaccaaagggggaaggtgtaatttaaacagacaccctttcacctattgaggaccaagctgatctactacaaacgtacgaattgtttgtcgcttctctagattaatcatcttgggctgactgcgctggctgctgaattattctttacagctccatacgtatatgtcccgaagaacgttgcccttgacgcccctctt

SEQ ID NO: 4837 - DNA, 192 bp, Bacillus thuringiensis
acgaaggattggcaaggttgtttttctgaattggcaccaccgataacaaaagaagcttcatgagcgtgaccgctatgtgttaatggtgtctatcacgaagaacggatccgattcgatactggcatggatgctgccatgtaccgagctctccctattgtgactagactcataacatggcgacctcatgtgaat

SEQ ID NO: 4838 - DNA, 175 bp, Bacillus thuringiensis
gcacaaggatggcacaattctttctccaaacgcgagattgatgcatcaacctgggaccacaatactgcggcaggttcatcattccagcagatacattctagataaggcatcagtaccagaggacgggagagcaaagttgtttgaggggacaaaaggctcagctcgactaactcca

SEQ ID NO: 4839 - DNA, 316 bp, Bacillus thuringiensis
ggatcattctacataactgcagcacaaacactcattttttttgctcatgctagatccttcgctacggggactaccttgataggtaattgacgttggaaacattacaatgcacgtgtcacgtcttgtgctaaatcgaaatcacgcgctgctgaaggagcatacactaagggcgctctcggttcgaacgccaatgatcgtgcccttgcaaaactgtgctgttatcaatcacaaagctactaaagcttacaaggactgaacggaagcacctgagagggtgcccttgactgttccgaccacaatttgttgtctgctgatg

SEQ ID NO: 4840 - DNA, 238 bp, Bacillus thuringiensis
ctttgttattcctttgtatttgacactcctacactatttctttcgaatgctatgtacgtcttaaatatacagacggcatgtatattatagtatatgtcaaatgcccactaatgttttaaaagataatataatatgacctatgcagaaaatatgacaaaatctccatctttcatttacatgcaccatattcctacttgataatgacgccatgtgggtaccatatacagcatttttgaca

SEQ ID NO: 4841 - DNA, 319 bp, Bacillus thuringiensis
cgcgatattcacaccctgaaccagaacacgaagggcagaggtccttataccccaaacaaaacccaaggatggcttgcacgatacaacatgtgctggcacggaagtgaagggcacgacgctgcgaggcacatggaaagcttatacaaccggtgggatcattaacgccagcctgaaaccaaccggttaccagcgctaacaggagtaatggtggacacggaagatccagtgagaggagcggaataggaaagggcgaggcgcgaggagcaaagaagacgcgtgcgcaaacctcaataaaacagctgagtgatgcatcaaaaaa

SEQ ID NO: 4842 - DNA, 184 bp, Bacillus thuringiensis
gatgggtagaatggttccagttactccacactgttaaccctttttctttttttacaaatggccagcagaggtgaagtatactggaacggcgtattcatacataaaatggattcgaatgaacgttttataagtatcgtgtatgtactgtatcctacacagtaccatcttacatttgatacagtct

SEQ ID NO: 4843 - DNA, 183 bp, Bacillus thuringiensis
cgattggaaaatagccttttttttatttgaaaaagatatgaaaagatgaattatacattttctgatgttggttatttggttatacattacaatacatatgtaggaagtttatatttttaccaaatcataaaataatccacatatactgtcctaaataatggggcggttgttagatagatccta

SEQ ID NO: 4844 - DNA, 117 bp, Bacillus thuringiensis
cgcgatcaattgaaaccatttttttttccttcgcaacagacgaacaaccatgggatggcttgtagcagcaaccatatgcctaccctgcatccacgtactcatcaagagcaaattgga

SEQ ID NO: 4845 - DNA, 136 bp, Bacillus thuringiensis
cgaaaattctccatatactgcaattaccacaaggactaacgttctttttctatattgaccaaaacgtaacatggcggtgattaataatggggcacccaacgggccataaagacaactggaactccatttccaaaat

SEQ ID NO: 4846 - DNA, 296 bp, Bacillus thuringiensis
caagatatatttgttccaggtttttttccacaaattgtgaatcctatctcaggattccggtggattgataatcaaatgcgtaattcggtaggtagtaaacaggagatgctggatctattatacaaactggcgacagatttctgaacatcacaattgcctccatactaaaaggatctgacggtgctatagagttggctgacaaagtgcaagaaaaccttataaataatacggtcactattatcgagggtaaaaattcaccgcgtgataattttatgaaaggtacaacgctctgggaa

SEQ ID NO: 4847 - DNA, 301 bp, Bacillus thuringiensis
cagcagcacgaccccaagcatacatagcttcatatctgcctatgtttcgcgatgcaccacttacacaaagcggtgagccttgcctcaagtgacgctccacagaacaaactatgacgcgctacgcgtgtagcagcagcatatagggtgagcggactgataaggcgtaagaatacttcatgagctactcatacgttgtctacagctcaggaaactccaagtcgtgctggtggtatacctacccactcacatggactctcaattgaacgcatcccacttgcaacgcgcttccctgtgtactccc

SEQ ID NO: 4848 - DNA, 180 bp, Bacillus thuringiensis
cagacagcaaggctttttttaaggacctggctaggcgaactatctcaagatacgctcaatgatgatcatacaaaaactggtgacgtcgcattgtcatgaataaaagacgctatcttactagtgacagggcatttattattacggggcaatcttttaaagactttattaagaatgctcact

SEQ ID NO: 4849 - DNA, 303 bp, Bacillus thuringiensis
cctgcgtgataagtattcgactggtacatctcatatgaccactgacttttctttcccatgttcgagcaacgctaacagctggggtctcttctatgaacttaccacgcacataaatatgtatcgcgcgtagctttgctataaaaaaatatgagatgccataagcgatctatgtcatagcccctatttaaatggcactggtacctgcacaatctccgaccttgtaccaagtctaatcggtggtgcccaaaacccaaaacctgaaaagaccatgtgcgtgggacgcacccttctgtgcgccttccc

SEQ ID NO: 4850 - DNA, 349 bp, Bacillus thuringiensis
gctcggaagcttgtcacaattagataaagcatatataataatttgtatttcagtagaggcgacacgaacttgggcattgggaagtatacgacatgtacgagctttatatgagtacggcatattgcttaactgaggagatagaaatgaacagggaagaatctgtcactatggattgttgttcccagtgactaatgcagtcgaagaaaggctcttaaacaaagcgaaatggcaatgcactttatgtggaagtgatacgcttgaaaaagaatgataagcaaagccatgacgttttgtatacacactccgcagatgttacattcctgcgtgggaagggaaacaataagtagcg

SEQ ID NO: 4851 - DNA, 301 bp, Bacillus thuringiensis
gactctagtgaggcaacacttaaattgaccgaactctcaaatgcttatggggtatgaattggccgtaccggcattaaaacagaatctgttggcgctagaacctccgtggatgcatctacaaaatcaatacaaatcgctctttctagcacaaaaaccagttcatgctaatgagactgatagtgtcaatcatatcctccaatacaaccagcgactcgtgagcatagactgattctgagtgaaactgcgagaacctgtgtgtcgtactagcacgatgcatgctacttgtatcacgaacgaatga

SEQ ID NO: 4852 - DNA, 424 bp, Bacillus thuringiensis
gtgctggagcgccttgggcatagcgttccgcatagcgactattatttgcaaagacacgaccgattggcagacgctgaacagcatgtaaacctgtctgcaccacacatagacgagtgtacttaaccgattggagctgatcttcctagggtcagggtgaaatgcatgccgcactgtatggctgtcccaactttctcacgtccaaatgtgcgcgcagggtgtttgttttgctgaaataagtcatatgaaactagacatggctgttcatcactggaacggctataagcctctcctgttgagtatgcttttacattatggagcacagcgagtgctaatgttgcacagcggcgcattgcgaccagtagagcttttaatgaggatgttttttctttttgagaaccattcaccgcgataagaacctttgttt

SEQ ID NO: 4853 - DNA, 401 bp, Bacillus thuringiensis
caggttatggcgtttttttgttatcaatgcaagtgcaacgtcgtgaatgaaaggttctgttaagaactttacgactggttgtgacattgatttcatcgcttgccatgactattgttctacgccatcatataaaattttcactatcgtctgcgttgacttgactagttccgctctactgcattctgttatacatgctgcgatgattaaaaatgcatgtttattaagactgcttctacttatccaacaattatggaattaattttacacaccttgttttggtttttgctctagtaaaggaagattttttaacttagtatgcattccaagcttaaatactgattgatctttattcacatttcatgagttcctcactttgaactctaaaatattattgcatttct

SEQ ID NO: 4854 - DNA, 359 bp, Bacillus thuringiensis
gactgatataatctatgatatgacactgtcaaactgccaattttgtcacctaccttctcataatgaccgaagtgtgatctcggggtcatatggaccgggtcagaatcagcagcactaccttgactcttaccagcaattgaatgcatatccgatgggatgctccctcggtcgaatcctatggtatgtacctgagctacaattgttacacatgtagtgctactcaaatttacaactgacagtatttgaacggaactacggttacgagcatgtcgtgactttacctactacatgatggcacgggtatcaagttacttgcaggttctacaacgcgttttcactaataaatggacatcaccaaa

SEQ ID NO: 4855 - DNA, 334 bp, Bacillus thuringiensis
ctggatttgtttttaatacatagtgcgtggtgtgggaatatcaacggcattcaatctttcttcgcgggttgacacccggcgcggagtggaacggcagaaataccgagggggtgctaaaaccagtgcaggtacattcgtgactgaccggttattgagaagataactacttaatctacaatttatacatgagctcataagcattgtgggcttatgagtaggaaggattctgtgcgatatggaacgattacccctcaccttgttgaacttgcgaaagaaggacgaatcgtttcccgcttaaaaggccgtgctccatctatgaatggccgagatggtg

SEQ ID NO: 4856 - DNA, 233 bp, Bacillus thuringiensis
tctacatggtacatattgtgtttccccaatattgagtcacatatatggctagcggtgtatattcactccgatgcaggaatcgtggtaccttgaaacaagtgggagctcgctttactataaacgtacacgctagtttaaactcttacaagggataattcaagctgaggtcacggaggatataaaaatggaattgcccaaaagaaaagatcgtgtctatgcgaaagcgtgccaag

SEQ ID NO: 4857 - DNA, 186 bp, Bacillus thuringiensis
cactggacaaggcgttttttcagaacgcggcttcggcctgtgtggcaaggtactcttcatgttgagtgcacgctgacagggtttgttcaattctctcgaataagcgttcgtatctttgtgtggaccatggactaaattccgcgcatgaacgctctacatacttttttaatcgtgcttactattttt

SEQ ID NO: 4858 - DNA, 217 bp, Bacillus thuringiensis
  unsure (1)...(217): unsure at all n locations
nngcctcgagaaggcttggttcggacgaatttcaagatttggccattctaaaccttaattttattatttaatggagattagccactttaacanncctaataagaatagaattggatgtttaacgaaagttttagcttcatgttatgatagaaaatgtattgaacccccggttcggcttaccaagaaattatgattggcacctttttctatataaagc

SEQ ID NO: 4859 - DNA, 221 bp, Bacillus thuringiensis
gctgatggacatcgatagcgtccttataatggaaaatttctgttttaatcgtcgacaagtgagctcattacgctaccaataggccgtattcaggaaaatccgtcaccaaataaaagaggtttccggtatccacatgagtgatgctctcttagaggaacaagagttctctattaaagatacgacactccatatttcatagactcttgacccactactcatgg

SEQ ID NO: 4860 - DNA, 288 bp, Bacillus thuringiensis
aagtactgaaaaggtttttttagctctgtgagcctccagtgcatactgcttctttcgatgactgtaaagtatgtttaactacctttttcaggaaactgaaaggtatattcttaattggttgtggcaatggaacatgttatgattcattaacatgaaccaggaactcatcttacatcacttatacgagacgtatctttcatttgtccccaatggtttttaaactctccatacggagcatatttctttaaaaatgatttgatattgttagaactaagacccccatttaca

SEQ ID NO: 4861 - DNA, 122 bp, Bacillus thuringiensis
aagggagaaaggtgtttttttttaccgcatgctggaagggcagatcaggctatcacacaaaaggagcatctcgcggagaaccccacgctttttcttatgaccagcggtgtttcccaccaatt

SEQ ID NO: 4862 - DNA, 468 bp, Bacillus thuringiensis
ggaccttactagttcctgtaatgtgaccgcaactgacgtatctatgaccgatattcttgagagcaccttatgtatcggtcccaactgtatctcagctatggggcatgccatccgaaactcctatcgatcaactgctgtaagtctcgatcccattagtggtggtaatacatgaatagctgcatgccccgcaactgttacttccctttccacacttaatcacatttctatctctgctcatagcacatatgattctgtcaatggtccgaaccatccacctattactacttccactcaatcatctacaacgtcgacacagatctgtagcgctttccttactgcaccgaacaattgctatgtatgtccggtagagatcgggccggatattacctacaccgtgaccacatcaaataacggaaatgtgagggcatcgagtgttatgttcaccgacctgatcccagactgaacttc

SEQ ID NO: 4863 - DNA, 125 bp, Bacillus thuringiensis
gatagatgactttttttatcaccgcagcatcgatactagcctatgacggcctaaagactcacacggcattgtacaatgccgtaatacgaataccttgaagacttgaactaacccgtccgtgtaca

SEQ ID NO: 4864 - DNA, 352 bp, Bacillus thuringiensis
aaattgttatccggaagaaatgccaggaggatgagccagttttcggcaggtgcaaaaaaaaacgggaaaacaagctgtgaatctacgaatcgccggccggatacagctaacgatcctgtacaaactacacccaggtgataaagagctggcaatacgaatagtacagatcatatggccacattccgacatgataacgacttcagtagatgctgtggtggatacgtgacaggtgactgtaatcgtacgcacatttgagataaagtacgacctctatttgctgttatgggattatgaacgcgtgtacctatatagtatcgagcttataagagagcaaactagcggttgttgatat

SEQ ID NO: 4865 - DNA, 159 bp, Bacillus thuringiensis
cgaattaagatgtttgtatcccagctttcttgttacaccacgccgatccaacaatacgaggggtggctgcaggcggaccatacgctcgtttttcttgtaacacattggatagatgtcctgatttcggatagcctgacgaaagcttccggccagaatgcg

SEQ ID NO: 4866 - DNA, 112 bp, Bacillus thuringiensis
tattcatataaaaatacatacttttttaatcatctatcatgatatatgtgaagagaggaaacattgcctactggccgaacctggtgatatgtgaaaagagtatcttggcatg

SEQ ID NO: 4867 - DNA, 194 bp, Bacillus thuringiensis
ctgtaacggaaggggcgttacgacgccatggctatatggtaccttattgctgtcggacgtactggcgtcccatcgtgggttctgagttaaatgggtgtaaaagggatacccattttctcagcctatcatgagctgccatgtgtcacacggattactacaacttgccgcatagaatcgagctgaatctgtgctaa

SEQ ID NO: 4868 - DNA, 218 bp, Bacillus thuringiensis
aagtagttcagtggtagattttcatccagccaaggtcggggactgagaagtcggagctgagagagggactcgcacctctcttttttattatcaatgaggagatggaaagatggattgtatcgatatattaaatgaaagcatttaatgcttccatgtggagggcttttgcggggtattttttgggaaggatgggaagccaaccttagaaaaatcctaat

SEQ ID NO: 4869 - DNA, 208 bp, Bacillus thuringiensis
tcaagtcagaggtaagatacgaaaactggacagctccaaactccaaatcgagggaaggatttgtcagatataacgttttggcttattaaagtgccaagaagtaaagaattgttaccgaatgtgaatgaaaataggctttagccaaccacttccaaaaggctttatttatcccaaattcaattttgagagatttttccttggggattta

SEQ ID NO: 4870 - DNA, 180 bp, Bacillus thuringiensis
gcgacgtatcggagccacaccccgcgagggaaaccaaataaaaaaaacgcgtctggacatacacaaaaacattttaccccaaaaaagacgacccaagctacaccaggggccaggaagcagacacaagaccgcccaaaaacaaagcaaaaggagcacgaaataggaacaaaaacacacaca

SEQ ID NO: 4871 - DNA, 194 bp, Bacillus thuringiensis
atacatgaacaatacgcaaaccgtggagtttatttttttgggcaacagcagccagtaattgcgatgtgtctagcagcacagaccataattcgccatattggatccttgcatttcgcatacaggacgataagcaagtagcttctatcactcgctcaagtctttgctgatccttgtcttaaatatgaaattgtttt

SEQ ID NO: 4872 - DNA, 340 bp, Bacillus thuringiensis
ataggcaaacatgatcaagctaaagaaggatacgctagcattagacaatacgtgcgggggccctagcatgaggccgttgaatattaacccgaaaaccgacatgccgaacgctctactgatacagttggtaaacaccgaggtgactgtatgctcaccggttgtaaccgcttataaatggtagctacgcatttctcattagccggcgggcgagttactaaatagcgaataactggtatgactttcctaacggtcgggcagtcagctggcgatatgcacatagacagcttccaatgcattcacacccttgtataatcttaatgaagcaaccgttacattgata

SEQ ID NO: 4873 - DNA, 166 bp, Bacillus thuringiensis
cacggaggctaagttttttctttacttcaggagatcatgatgcaaagtcgatgcaatatatggtaactgggtcgggccagcagtatctttaatatacttactatgcgatgtatcctagtcttttcagagcctatgaagaccatcaagtagcaacttccgactttgt

SEQ ID NO: 4874 - DNA, 258 bp, Bacillus thuringiensis
tccagaggcttgtgcacgattacactattccttttcttcgtcttacttttttcttttctcccgccgagaccgaaggacattcccttgtcttctgagagagataactccagccgacattctctctaacgtatacgctgtatctaaaacgtgctctgcggcctaaaaccgaatgagtttgaagacccataaactggtcttttgctatacagaccatgaccttttgaaccggttgccgaccttttattggaatcgaaccat

SEQ ID NO: 4875 - DNA, 341 bp, Bacillus thuringiensis
ggaaagagtgtagatgcctctttggcttattcgatcgatgacttgctggccctggttgttctgatgaccagggccgctcagatagcgtgatggcgaaaacacaggatgtcacacaatcgatgaatgacgctactttaaaccatagagctagatgctatctgccggctcatacccatccaacggccgagcagctggcgagggcatatacgctccttgcacatgacctgcataacaagaatgaactctattcacaaaagagacgaagcccttcatgacattgggagtatccgacgtgacctattgaaaacttgctgctgcgctctgcttcatcgtcactgccg

SEQ ID NO: 4876 - DNA, 193 bp, Bacillus thuringiensis
tcaaaatacagggaagcaacttttattgagttagtcatagaatatgggggtactagcttgaatacattctggctaactatgcgaatgaaaatatacacgaagtatgtcatactaacattcgacttcagtgagagggaatgaccagcctaatttttaatcaatttgatataacactaatgtaaggacaaaccgt

SEQ ID NO: 4877 - DNA, 379 bp, Bacillus thuringiensis
cggcatctcttccatatgtttttcgaaagatacaccatatagctctgaacggaggaacttttacgcagataccatcttcttcgctataggaatctgactcgatttcgtagcgatgtcaatgcccgctatggtatagagtgcaaaagccacaggtttttaccacctaccttgcggaagttgcatccataaggaaaaatcccgtctactaaatacgtcgcacgacattcttgcttgtgattgaaggaaaagactatgtgcactctctcttaaccttgacgtgaactctatccaatctcagggcccgtgatgccttttgtttatactatctagctttcgcagattgaatgctccgtgggtacactccttcctacgaggcaaa

SEQ ID NO: 4878 - DNA, 142 bp, Bacillus thuringiensis
atggtactaccctattcatgacgcatatcgattcactgaaggaataatcgtgcatcctaccgatcaatatgcagggacccaatatcatcatgtgcataagtcaatggtgcatagctgcatagctgctgttgaaacgagatat

SEQ ID NO: 4879 - DNA, 178 bp, Bacillus thuringiensis
tggatgaatatccacctttttttctatacccgagcgggcacccagagtggggggtcctattagtctaacatatatacttcctcataatgcattgcccgcaatgtggcactactaccccgagcatttcataaactctcaaacctctccctattacatctgcgggtaaaacaaataggag

SEQ ID NO: 4880 - DNA, 236 bp, Bacillus thuringiensis
agataaactgccgatgcagttgtttttaagaaggctggattttaacgttctcgtaatgtttataacgatgccttacagatgaattttggcagttttgtagcggtgcaaatctgagggagcgtatcttcatcctaccataaggttggctatgaccgtgatttatatgcaaccctacaaaaggacgcgtgtgcaaacggcgatgcttgctaacaagacgtgtgataccaccgacgaag

SEQ ID NO: 4881 - DNA, 142 bp, Bacillus thuringiensis
gaacgcattaatttgtggaggtcttgttttgtacccttgtttttggtctgatgcaggtggaaatgatctgcaccataatttagtatataccaacagggtcgggtttccccctgcacagacggatggccgattgttacactcg

SEQ ID NO: 4882 - DNA, 361 bp, Bacillus thuringiensis
gggaaactccgacgccttattttctatccgaccacagtgcgctaagacacactgccgctacggtgtaaccagaaaaccccgtgcgcaagagcgcgtgagcacatgaccattaccactgacgagatgcaaagcctccatgcaggttggcaaaagatctgaaggggcctacgccgtaacacaaacaagtggagagaccaacaggattaccaccgaggcggctgcccaatatacttaggtgcgtgtgcgaaaacaccgcgggaacaagaacaagacactgttagcaacgatgcaacgcccagccggtagttgcgcgaacgccaatggtgccaataggagcgcttcatccattccgcctacatta

SEQ ID NO: 4883 - DNA, 323 bp, Bacillus thuringiensis
tagaggcgacgctggtcgtatttaatgcgtgggcttatacacacattgagctgatcgcacctcatttcgcaggcgcgggtcccacatacgactgtgacggcgttgtaagcgccaaatgtggaagcgatgtggtggagaatgtgaaaacatgttgactgggaggcatgattgcataaatttttacctaacacagaatggaggaatgcaagacggaatggatgcacatctctggctggcagattgattttggaccgctgattccctacgctacatcatattgggctattagcggcagctcaatgagtaaatctccgggggagtac

SEQ ID NO: 4884 - DNA, 213 bp, Bacillus thuringiensis
cactacttctaggaacagcgacttacgaagatggatttaatgctggttcctatgtattactaacaacagatgatcaaatgctagtgaatcaaatgggcgtagctcttttctgcgtgaaatgggaataccttgaaacttccactctgttttcactcaataatctggaaacgtgtcgcgggggctgcactgggacacagaacaaattggtcaatg

SEQ ID NO: 4885 - DNA, 186 bp, Bacillus thuringiensis
ccttgtgcatctcttgtttctcaagcccctatggctgcacaagccgctcctgtattgctggagaatacattcccaggcttatcactacgatcgccatatgctgcactcgctaacatgaccctctacacctacaacatacattcctcgctagttacgactacatctccctttattccacgtgcatta

SEQ ID NO: 4886 - DNA, 219 bp, Bacillus thuringiensis
ccccggctcgaaaggttggtcgccaaattaatattgtaaccatggaacggactgttttgttgagcaccactgttaagcggttatagagctcggaatttataagcttgatacgctggacactaaccatgttttccaagcagattttacaaaacttgaggtccatggaacaaatggaacccgtacttgagcgggtttatccctacaagaaagtgatcttaa

SEQ ID NO: 4887 - DNA, 106 bp, Bacillus thuringiensis
agattgactgctgatgcaactttttgtcaaaagtcgcgatccaggtacgcgccaacactattatggaaatgataccggaaaacctttaacaattatttcgttgttc

SEQ ID NO: 4888 - DNA, 147 bp, Bacillus thuringiensis
gtggctaatgacaccgccatgactgcggattgatcccagttttttcagtgagaggggagcattctagggactgtgacgatagaccgctttgactggtcgcggtcttagtcattatattgctctaattatgagggaaagaccggagag

SEQ ID NO: 4889 - DNA, 267 bp, Bacillus thuringiensis
ttacacaagcgcatcattctaatcttacagcagaggccaacccatcatggatagctgtgctcctcaaagtgactacaccatagaactcccgggcatcaatgacacactgcaaggagagacctattagtcaagccttaagggtgtatgtggcagctgaacgctgaaccggaacaatacctgtaggacaaccattttaaaaagcccctttactggcacacttgattctgtagcgtacaccgtatgttataaaacgtttaatacgtgcat

SEQ ID NO: 4890 - DNA, 173 bp, Bacillus thuringiensis
tgaagtagttgtaaagcttttttcaattaagcacgcaccgttaaccgcgagaggttctattggctgaacaactgatccaactttcgatgcatgcatcgacaattacatacaatactccacttagttgcatgattgctatcgttcctaattattttacaattcctgtaaacata

SEQ ID NO: 4891 - DNA, 199 bp, Bacillus thuringiensis
cccccccacacgttttgtatactagctcgccctcgctaaacttgcttgccaactaatacagattgagcgctggttcatttttttcccataagtatgccacaatgggcgagcccttagctctcaacttatgatacagcaggaattttcgccttacctttccagataaatattgttctggcgaaccctggtctttcacttg

SEQ ID NO: 4892 - DNA, 242 bp, Bacillus thuringiensis
gcttttgtctcgcaggacgctggttacatccctattgatggtgcctatgcgtaacgcggttgtcgaatgcttggttcccggcaacaccctgtttggaggtgtataagaacatggcgtcagcctggtcataggtgtatccggggtcaaagttgcatggtacgtcaacggtatcaccgacaccagcttgaagcattaagtgaaaagcctgggttgcctttttagtatagcgggctacaggaact

SEQ ID NO: 4893 - DNA, 131 bp, Bacillus thuringiensis
gatcgtacagatgctctttttttacaaacattcagttgactactgatttgtctgagtagctagaatgtacaccgcgtgattatagagtactctttccaacgtgtgcataactagagataccatctcactgc

SEQ ID NO: 4894 - DNA, 242 bp, Bacillus thuringiensis
cttgccaactcatatatatgcacggtttgtgtaacttgttatgagtattgacgatccaagtacgcccgcatggtggttctgtgttgaagaggtgagaccggtacaactatttcactcgaccctaggacaagtgctctctcaggaatgttacttaacggtccatttacaagtacatcttaccgttgaccatagtgcgcactggacatcttggaatatagagttggaaaacctactgcatatca

SEQ ID NO: 4895 - DNA, 223 bp, Bacillus thuringiensis
ccgccacgttcacaataatctatgatgagatattagctaactggtttttttttaacccaagccacggcctatgagcaggcccattcggcacacgacgcaacatggctgaggaaccatactgtatcaatgtcatttccggtacagactgcattaggctctggatgttcggtacatcgccaagatatttgctacctagaattgttgcacgagcgcactctcatca

SEQ ID NO: 4896 - DNA, 186 bp, Bacillus thuringiensis
tatgccgatttcattgaaattttctataggttacggtacaaggcatgagcgtgggtatcatagcagcagctgaaggcgagtatattggtatgcttatgatacagcgaagagccgttaaaggaaatgtaacataacggatgtacagcctcgtattaaaagcgatgcattatctagcttggtggaaaa

SEQ ID NO: 4897 - DNA, 380 bp, Bacillus thuringiensis
caaattggccgtgttagaaagagatttctacagggtagcgttcaaggcatgagcgagggtctcatatataactctgacagctccgttatgggtatgctgattcaccatccccatatgatctagcaactgtttcattgggagaagcattccatgatcgaatacgacatgaatattggccatatgtataaaagatcactaatcaaggtatcggtgctggtactcctacatatgaggcgacgcaccaagcgtcactgcttcgcatcacttgcatgtacattgataaaccatagctatataaggctgacgtgcttatatgctgcatccttggacgtaattgacgggactggttaatactgcatatcaacgttctctccaatatc

SEQ ID NO: 4898 - DNA, 282 bp, Bacillus thuringiensis
ttatcaaaaaatacatttttttttttatgaaaccctctgtacggattacaaacgctggggatttcgcattcgcaggaatcataataagacacacatcatccgatagcgctcactttagatctccctcgaaaaacccaactatcacgtacttctaaatctccccattttctttctgtaaaaaacacgtagatatctcttcacgcctcaaatacatcattatgcaaattgctatcaagaaacaaccaactggaaaacaattacgaatatgagctgttctttcct

SEQ ID NO: 4899 - DNA, 203 bp, Bacillus thuringiensis
tgagcggtgccaacgcccattggggcacgaccgctagttggtaattgcatattaatagttgttcccgtgtcgacagaagaacggaatcggacgcatgcaccctcgtctgcacttttatcaagacccatattatgtgctaacgggtcacctgttgtttgaggctgagaagatgaaacaacagaacctactggccctttagttgc

SEQ ID NO: 4900 - DNA, 238 bp, Bacillus thuringiensis
taaaacacgacattatcatttctctgaagaacaagtagccctacgggcaaggtaaccataaatagaggccatcccctttgcggatccatcttagggcatgcacctcgttatagcagggcatcgcagacgcgcatgggaaacgacagccggtcgtgcgcgcaactatgaaaatacaatgtgcccggtgggccgcacgggtgatcggttaagtacgcgtggacgggcccggcttaaggag

SEQ ID NO: 4901 - DNA, 243 bp, Bacillus thuringiensis
attattcacatcgaagcatattttttccataataacctgaccgacaattgggtggagagaaacaactggtgccggctcacacagatatggctgaatcttgaactgacctcgacatgcgcaataatgtaagaaatccctcctagcactataggggattcttaaccttaactaaaaagtcactgttacgtggacactttaataccagtgaacatccactattggaccatcatgactatcatacat

SEQ ID NO: 4902 - DNA, 251 bp, Bacillus thuringiensis
aagctggtcgacgactacatctgatggccacgataaaacgttttttttaccgacctcccccaccccctcatgggggggattccggcatggaaaccggggggcccccttaaaccagaaccaggacctgtcccgataaatttaattaaggccgtatttcgcccaggccaattgggaactttttaaccgaagctcaaaattggaaaatacctgaacaccataattgcgataaaaagacaaacaaggccaattgg

SEQ ID NO: 4903 - DNA, 232 bp, Bacillus thuringiensis
aataatcccgatctgaccgctcttttcacatgactttactgttcaaacaaatggtcctttatgaccgaacgacaatacttttacttcatcacctgcacgtgactgccgtctgagcgcagtgtttcacacagtgaccctgtgcaacttaacaaggtcaggggctgtgccttctaaacggttctaacaccttacaaacttgcgggctttaactgttgccgcttgtgctgtacac

SEQ ID NO: 4904 - DNA, 357 bp, Bacillus thuringiensis
ggatgctacagaaaaacgttttttttgcagaacagcaggactatctcattcctatgtcacacgtacctgcaaccgccgtaccgattactccaagcgcatgtgctgctgcgtcaaggtatactaatgttgtatcgtcacctggtccagttcggaccatgccagctacgattacatttgtgatctctgttcctttaacaactgcgtctgcacctctatcaaaggcagttggcactaacacttcgattgaggcgctttctacccaagagtctacacatgcatcacgcgcgctaacctgcggggcaggaccgacttccggtgctatgccaaatgatctctcccctatcgatgcgatgcctt

SEQ ID NO: 4905 - DNA, 137 bp, Bacillus thuringiensis
accaacctacacctaatccagggggggaggtaagctggaacctttcggggagtaaagggatcgaaacgttcacaccgatagactcacaatcagtttgtaccagctgcatctgaattggctgcaccaaaggaaacgac

SEQ ID NO: 4906 - DNA, 228 bp, Bacillus thuringiensis
ttgtacccaccagaagcatgccttgctacgggccttccctatggtgagtcggatgaaagcacggctcctgcaacagcatagcaaccagcacgaccaccagctgatacaccagcagatgatcacatgtaagctgtcgatggcgtcaatccgaacatagaacgcaaccgtagctgagaatgagtccaaatagaagaagctcgtccaagcttttgggagtttttccggctt

SEQ ID NO: 4907 - DNA, 430 bp, Bacillus thuringiensis
gtcaccaattccaaatacccaaaccggaagatcatttttgggccaatagcttcgaccatgtccatgcccaaaagtaattacgtgcattccgaggagaggtgaccctgacccgctcaccgcctgagacgcagtttaaatgcgtaagtgctccatctggagtttctggatcaatggtgaccacgccttctttactggaaactgctactgatatcggtgggccagtagggtagacaggtggtcgtagctaatcattgatcgggctgatcatgggattataaacaggggggcttttcactagccctgacaataacacgatcattggtgcgctagggccacatatagctgcgactgggcgaccgaattttgggaccgctattggggagcgcccaccggcggttatgacagcgccacttatatagggtgctcctgc

SEQ ID NO: 4908 - DNA, 145 bp, Bacillus thuringiensis
taagaccgtgactagggatgatggagatatatgaatcgatttttatgaaactttctgcaaaagcagaatatgtggttatccttaacttaacaatggctggtgtcgcgactcgaatgggcgaggcttatcacatcccaataaatat

SEQ ID NO: 4909 - DNA, 229 bp, Bacillus thuringiensis
cacgtgtggtgctgagctaggctcggcacgcgaggctagtaatccaattcagatcgtccacagtgcagtaatcctgttgcgtcctgtatcgagcgttgcttgcgccaaaatttgtcaaaggggcggagcacataccggaccagtaacaaccaaatgaaggaaactgtctgaaactgcttttgacattgcactataatcaacaaaacgagctgacgttatccttgagcat

SEQ ID NO: 4910 - DNA, 117 bp, Bacillus thuringiensis
ttgatgaacagctcaagccttttgtttttgcaactttgcaaacaataggcttggatcaaatctgctttgcgagtgcttgaacatacgaggaattaaacttgctctcgacccagctgc

SEQ ID NO: 4911 - DNA, 198 bp, Bacillus thuringiensis
cggttgctatttgtgtacatgcacctcacccatatcaaactttttttggccaatggataatgcgcatcacctgagagcaattaaactgtcgacatgtgaagatataccacttggcaaaatcttactctatgtgaaaggacaacatctcttaacgatagcatgcggatacaaatttataaatgttttactcatacatgt

SEQ ID NO: 4912 - DNA, 165 bp, Bacillus thuringiensis
aattggccaaatagcatccctacatcttcgtcaagacatttgcctatcttctgatatatgttcatatcgtccagctgctaatcctgcagaaacagcagcaccattttcaacatcttaaactactcggcgtccgtgggagaggacccgatagatgcaactggtcgt

SEQ ID NO: 4913 - DNA, 129 bp, Bacillus thuringiensis
agtctattaattgttgccggcaaccttcagtacgctctcccccttttttttgagcgctcaactccactaccattacggtaggggggatcaagccccaccacccccttttccaaaatccatacatacggc

SEQ ID NO: 4914 - DNA, 185 bp, Bacillus thuringiensis
agaagggaaagccctatggtttggtttttactaaggaggcttgcataagcgcagggcgacatctaccatttaagtgagcgtctgcatctgtctacatgtgaaaatgaaatttccggggaaaaggttgaagggctatggctctaatgtacggctaaacttaactacattgtggacgtgatttgaac

SEQ ID NO: 4915 - DNA, 406 bp, Bacillus thuringiensis
atgctgaggctcgaatacaaatacatatggatctatgtgccgttttcttaacactgcgactaaaatcaaatatatggacctaatgtgcacgagctggggttcacccttcagtacaaattcattgaactcacaaggggtgagcagaatgcctgaagtcagctgaatctatattctaagatgaaccaccatgacgatctactcgcacgcacagcgtataatttgttcgtcagcgcctgatttttcaacatctttggtccctcttcttgggtacgcgcagtttcgtgatctataatctactcgaactggacttggtgcaacgtgcttggtacgattcattccgtcagtatattggggattttcagagcccgctggacaattctaggctgctcgtagaatggcgctgatt

SEQ ID NO: 4916 - DNA, 277 bp, Bacillus thuringiensis
ttgcacctgcaggactagcgcatgggctacagcttacgttttttatagcacatgcaggaacacatcccgttggggggtgagaacaaaaaggacttgtgtcacaatctctaggatgacaaatctaacgaggtacacctccaccaatttagtaccagagcaaccggtgttatcagctacatgaatgtccattaaatagagaccgacttggttggtgtattagcgcttataggggtaaaaaggcgatctcctcatggcggtaatgtcgatgggattttta

SEQ ID NO: 4917 - DNA, 317 bp, Bacillus thuringiensis
agaagctgcgacaacagataataatctgatttttttttgctactgagcatacacctgagagacggggactaatggattaacacttctttgggcatgttgtaaaaatcttatttctttcctaacgctagacaattgacaagcctttggcagcaccttatgcagccaatctgataaataaataccgatcttaacgctcaaattcagggttacgcacgagaatatattcactagttaaagatgaagagcccccttcgtttcttcttaaacctgcaaccgccttatatacaagtttatactaatccttcacgattatttat

SEQ ID NO: 4918 - DNA, 498 bp, Bacillus thuringiensis
atttaaaacccatgcaaatttaaggaaatccttaacagtaggaataactcttgttcttggcttaacagacggaatagttgacaaaaaattcagatacccttcttttccttcaaaattatcatagtaattataaaagttaaaaatagctgaagctatagtagctcttactgtttctcctttggacaatattctttgagtaaaatcttctaataatgctattctaaatatatttgtttttatcactttatctagtacatacttgaaaatagcacttacagtactgaattgatacttaacctataaattagctgcccaacatttcattactattgttaatttttctacttttgatacagaaacatccactcaattctttctattaatctactgaaacgaagataaaacatattatctttttcttcatcatataaattccatacattttcggaaaaattaaatttctgtaaacttatttttttctatagtttctaagttttc

SEQ ID NO: 4919 - DNA, 507 bp, Bacillus thuringiensis
acccattggcattcctgggtgaccagagtttgctttttcaatcgcatcgatggataatgtgcgaatcgtgttgatagaaagttgttcgattgaatgtgacatgctattcttcccttcgcttatattagtaaacgttttatacatttatatgatagcttcccacgcaagattatacaacatgtatcgacaaatatgttgatatttttttggttttttataaaaaaatcaatgttcccgggaatgtatgggcattcaatatgacatactttttcattatttttattttaaaaagaaaggggaataatctgtatatttatacaaattttcttctatacttactttttttaatacgtttttaaaaacacaaaaagcatctaacttcgatgcttttcaaataagttaaacaatccgtttccgaatcgagcttgaaatcaaatcaattataattaccattaaaataatacctaataaaataatcccaacacgagaccaattccgtgaactcag

SEQ ID NO: 4920 - DNA, 244 bp, Bacillus thuringiensis
gaacctacctatttttcacaggcgttcccaggaaaaatccgggcgggcgcttacgcaaccaaacttgcaaactcacctattgaatcatacactctgaaactaggagctttgctgctaggatgaattgtaagttcttgtcctcttggatggaaagcaatgtcttggccctaactacctgtcgttcgcagagaatttaaattttgtcacgctttgttcttgagcggcagcagcgacttttgtttta

SEQ ID NO: 4921 - DNA, 284 bp, Bacillus thuringiensis
gactccggaaaacacaccaaatagcttccctacaaacaaatctgcaaaagatttagcgaatccattatcagctgccaaacttggggctccatagcgatggtacggattagcgaaacttaccgctatcaagcgctcttttgcaactgtcatactacccagcatcacatcacaaatcttcccttgaagaccttgaatcaccgtttcccatgggtcggtaactggcgtatccttcatggccatctttaaagcaagagctatcctcgtttgtacatcctctccgacaa

SEQ ID NO: 4922 - DNA, 207 bp, Bacillus thuringiensis
ggaaacgtaatcgcgaactttttatgtttatcaagctacataacaaagagaacagcggaggtctgccatcctttaacattgaaaatcgctcaattgatagattcaaggcagatgcttgctcatataaatcctttaaaaatagatcgattactatcatatactttagactgttgtagcgttacacgcgccactttttgctaaccaact

SEQ ID NO: 4923 - DNA, 125 bp, Bacillus thuringiensis
aagaactggataataaacagaaaaggaaataaagaatccagaaggggatacaccaggtacttgacacaaaagactgaccatataccgaaaggagaattacaggaggacagaacgaataaagaaga

SEQ ID NO: 4924 - DNA, 496 bp, Bacillus thuringiensis
tttcatgataaaatgaagtcaacttccagaaaaagggggattttaatgcgtgaggaggagaggttctcaaatctcagccaaaaagataaaataataattattaagtgacaagaaagagtaagaatacaagcttttctatataaaaattggtacaatgaaagcaaatcttactaaagaggtgttaattatgaacttacaacaatgggctgataaaggtatgtcctttgatacatatgtgaatgaaatgcaagtaaaccaatactagctactgcacatttacaataattttcttaattccaaatgaattacttcctgtattagaagaacgtcaaaatgatggctggcgtgttatcgtattaactgctgattggtgtggcgatgctcttttatgcgtacctgttatgaaacgaatttctgaagttgcaaatattgatatgcgtttattaattcgcgatgaaaacttagaattaatggatcaatatttaacaaatggaac

SEQ ID NO: 4925 - DNA, 270 bp, Bacillus thuringiensis
ctgcacaggctacaccgtttttatggtcaggtgataactcatactgatgagaaggcggcagagctgcgactcccgatgaaacgccggatccttgctgttatcgaaccgccgcagaaggcacatgaaatggatcaagcatcggctataactgcaaaggggcgcgtcgaataggaacgattatgccggcgagctagctagagaatgacaaagatatgccagtgtcgaggaggacgaacaaacgaccggacccaacgatggagctgtgatggc

SEQ ID NO: 4926 - DNA, 394 bp, Bacillus thuringiensis
tgcgatcccgccaccatgtgccattgcaccaatgacgtgttctagctctcctatgtgcccctcacactcctgctgcgttctttgagctcgttttgcatatcccttaactcatcccgaactcagagtatcgaattcccagcgtccacagatcgcacagcacgtcgtattgttccaagagcgcctgctgatccttatgcttctggagcaatagacccaatcgcttgccctatctgtcgacgtgtcaccggtgcacttttaagggcatttactagacgatttcctcttgcccctgccataccttacactctttcgcctgcagcgctacacgacgtttctgatggtcttgtcgaacttgccgcacttgcttgctcagcttctgtaccagcaggcttat

SEQ ID NO: 4927 - DNA, 212 bp, Bacillus thuringiensis
cttctcaggctacactgttttatgcctttgtgacaccaaatgctagccatattctataaacagtgggagtgaatatgcaccgccttatctatgatgtaatccaaccgtcaatgaatgatgatgaaatggctcaatcatctgctatgatcaccgaggttcctgataaactactacgacttcgcgctagagctcgctcggcataaacaaactta

SEQ ID NO: 4928 - DNA, 272 bp, Bacillus thuringiensis
ggagccataaagccgaacaccccgccaatgcgcccaaacgcaatatttcaagcaaaggaaaaacgcagcacaacaagggcggtaaaaccattaaaaacaccaaactgaagaagaaatccgaaacgccgggacccagacaaggatcggaacaacaaccacaaagaacagagcaggcacaaaggctgccccaaaaaacaccacagcatgcaacaaaagcaccaatagccaacaaacacaaaggaaaaagccaaacaccaagcacaggtaaagcc

SEQ ID NO: 4929 - DNA, 290 bp, Bacillus thuringiensis
cgggaattgcgttagccccggggacactgccgcactgtacagtattatttatgaagagggcacccgcaggaatgataccggcgaacgacacatattcccagggacgttccaccttcttgtaccccttccacaatatagcatgacatcaccaacatcagcgaagattggactcgttagtttagaagcaacgatatcagcagcccccaatggagtagcaaacgatagccgctcgcaatcggcaggtggcatgagccacacccattcccgagtcatcgactacaattttgaca

SEQ ID NO: 4930 - DNA, 133 bp, Bacillus thuringiensis
cgccttgcagcacctgccgttagattttatataacggagatagaacgaatgacgtccaggattgattggacgacagaaacgaccagcactaatggtaaaacagtcctggatggagctatcgccgagtgatcgt

SEQ ID NO: 4931 - DNA, 500 bp, Bacillus thuringiensis
tcactgttgctctctttttctctcttttgtgagattaggtttgagcatttcagcctccaactaaaatgttcacatctattttgcaatattagttatataagaaggccttgactctttcaccgcgagaacatagttgaaacctaacataaatgagcaaattcctaagaagaaaataatataccaccagcactaccctgatatcttctcaactttaatttcccttcatgatttgttgctatttaaatttgttttatcttcaagtcattaatgtgcaaacaatagtattgagttttggaccttctgctagtagcttgctttattctttttgaaaggagttatccattctcctgcttcagatattgcttctagaacaataacctctgaagaatagctttgatcttatgctttagtttgcagtggtttaaaaacatctcttcctattgagacatagagacaacatcttcttatgaatctgaactctaggaatgcttgacaaaaat

SEQ ID NO: 4932 - DNA, 502 bp, Bacillus thuringiensis
cgtgtttccatttccagtagagattactattgcttatgtacatccagttttccaacagtcatgtcctcataggaagattccacttcctttgtagttaggtggggtttcattactacttctagcaaattacatgtgccagaagtcatttatgtgtcacttgctgccaagacatttagaaacaaacgtgcctcttctatgtttccaactgccctgcctttgatagctcggaaggcatgtgtaaagaaggcagcacaccacaagatagaggaagggtgcctgggtctctgaatcactgcatggagtcaagactctactgacatgtctttctgtgtgccagaaataaactcttatatttttatttttttctgtttcaaggtgctaagcttgccacactcttagatttgagagtgtattagtttttcaatatggccagttttatcataactaatgtactattattttgtaagcttgcttgcacatccttacttaggcccatatgctt

SEQ ID NO: 4933 - DNA, 171 bp, Bacillus thuringiensis
gcaacaagactcacacctgttttgggcgataccatcttggggacacctagatgctcaacatgctttcagctgttatacctgtcccacatacctgcccagctctgccctaggcccaacaactggaacagcagctgtgcgtgcatgccgggtctatacaaccaaggacagcgc

SEQ ID NO: 4934 - DNA, 207 bp, Bacillus thuringiensis
cagagcataattgtgatcttgttcatttttatgactgcgtcttaacaccacggggtggaaaataaaaagggccacgcgagattcgtacaccaagaactctaaacgcactctgggtgataggttgccaaatgattgcatgaaactaaagatccaccacgcttttatatattgatattcgatctgccagcggagggaggtaaaatcatg

SEQ ID NO: 4935 - DNA, 281 bp, Bacillus thuringiensis
tgggcccaaagagagcacgctatgtactcaagtttggaccaaataaagcatgctcccatactccatccgcatttccgttgctacaccttaaaaataaacttgcatttactgcatcccctatatgtgagcagaatgcagaatcagatacatcagcactaccagaatctgcacaaacactgataccacctacataagagcgtaactgtcatgcccgtaaggaaccattgtgataaccgacatagagcgtgcatgcccaagaattgatagccccacaagaagca

SEQ ID NO: 4936 - DNA, 131 bp, Bacillus thuringiensis
ttgtacgaactatccatctatcatctacactcaatataaccttccttatggcattaaattcaaatgctcttacggtctaatgaagcaatacccttgttgctacaagacgggggtagcgattctgagcacat

SEQ ID NO: 4937 - DNA, 292 bp, Bacillus thuringiensis
acgcgttctgttggatcccacttcggatcagaatgcataatcttgacagaggaattctctcatatgtagtacactagccttttccagcatgagacggggtggcatacggttcatgttgagatagagagcactagcccgtcctcctatgactctgttgacccgttcagctacggatcgatggcaacccactcatgctacgccccgaattattcccactggttaaaggacaacttgtcaacctgattaataagagtgattcatacattgatcaacaattgggactcacccttca

SEQ ID NO: 4938 - DNA, 405 bp, Bacillus thuringiensis
tatattttgatggccgattgtggaaggttcatacgaatgcaataaaggataccggttgaccccttgcatgcatattacccactctaaagtgaaccgtatttagtggcagaaaaacagatctcagcttatttttatgggaaagaatagatgcagaatacgctatatttacagtatttccttcttggaagatatgagctacactatcccctcacgtactccctctcatatgtgtcattatatttcaaaacgagatatcctgtatcaaaagaaccccctaatacagtttgttggagctgtagaggaggcttatgcacactgataccgtgtatatggcaatgtcaattctttaaaaccaggaagtgccgataatgtataaagcagcaatttttattgtactcgaaagca

SEQ ID NO: 4939 - DNA, 403 bp, Bacillus thuringiensis
aaaaaggttgcgcgccctggccggactcacccccaccattttatgtccccactatgcatattgcttgcttgtactgcaggtttgaattgtattttgcatactctttcttacaatggctcctcttccgttggttaggatgataagcggtaagacgtgtcccaaccccgaaagcttgacactttgcttgtcgcagctttcgagtaattcttttaagatatctccagagtgggggggaatgccctcgatctagggagagtatgtgggacatcgtatacatcatatctgtcggagattcattgtgctataacttttgaattggtggcttaatgggagcattacgcacttccttttaaatgggctgtaaattttaagccgcgtataaaatttcgactccttattttcc

SEQ ID NO: 4940 - DNA, 495 bp, Bacillus thuringiensis
tttttatgaagaagatattttatttctttttttatttatttgaggatttgctaaactaagagtagaagcgtattaataggtggtacatacatagtgaaaaatgagagtatatttgttgggcagaggacagcggaattatagggcgtgctcaggtgctttaaaaagatataaaggggggaaggcaagggcacttagtgtgaattccttgtgtgaaaatgaaaattggaattgttggaccaggtgctattgggctattgtatacattttaatttacaaaaaaattaccctagatgttacgttggtttacaagaaccatttaatcaagcctgaaaaaattaatatgaaacagggtgttaccttgtatttaaagatggaaagatgtgaaaacagttatttccatctggttttaccgatagataagtttggtagccgcaaaattttagattatataatttattggctgtgaagcaatatcattatagatgacgtactacc

SEQ ID NO: 4941 - DNA, 255 bp, Bacillus thuringiensis
ctgctgccgctgacccccttttttgacaggcaaaagccgcgcaactcctgaggcctgttgagcgaccactttctgcgggaggacaggccacttcagttgcacaagctcccgtctaccagaatgtttgcatccgatccagaactcctctattatctgcgtggttccgatcttaacctatagtcagtcacataacagcttgatctgatcacggtcaaagctgcaagctgagtgaaatttttacacggtcataattcc

SEQ ID NO: 4942 - DNA, 280 bp, Bacillus thuringiensis
tccactccgaatcgtcagtatccggcacagtaacaggatgcggattttgtggatcaaaagcgatttacctagttgacagaattcttcgcgtcctcaaaacagataattcatcaccggacgaattgcaccatgtgttcacgaacgcttaaccgacgctcttaggagcgagtatgccctgcccgatcaatggtggcatgttgcaatctcactgatcataggaggtgcatttgcctcttcctcgtctcttttattgacaggtaatcgcctcgtgttaaatggt

SEQ ID NO: 4943 - DNA, 481 bp, Bacillus thuringiensis
ggagcaaccatgatcttttttaggtttctatgcataccactcatactctttactactacctaactcggcactctctattaagactaatgccctagcttatgcattacatgtacctatgccctggctctatcacccgaccctatatgtatatacgaactccacgcaatagacgcccgggttgccatattggcgacgcgcgtagtaccttcccttgattattcgccatttacttttgagtcatcggtgctatacgtgcacatgcatgctgtcgacactgcctaccagtaattcgtggagttaccatgtagcataacggctgtatatcgattgattcggcatttgataatgtgttaatgacagtatctaatgctcaattgatgtgcttgggagggagagcacccgagtattggtgaaccaagctcgttaaatccatacgctgtctcgaatacttcatatgattgattgggatgaatagctaccc

SEQ ID NO: 4944 - DNA, 146 bp, Bacillus thuringiensis
gtaccagaaaaccaacacgaaacaaacaaaaaagccacaccatttttcccaacgccaccagaaaagtacacacggggggccagcggaaagaggcaaaaagcgccgcaaacaacgaagcataaaaaacacccacaacaatacacgaa

SEQ ID NO: 4945 - DNA, 277 bp, Bacillus thuringiensis
ctaattcagattgcatgtggacccggagttttctcgttctgcataagctctagacgagcttggcgtgcctcaactaatacctcaaaacaatctctccgttcccgttgctacttgctaataccgtcaaccgatgctgagcatcaactagcttgctgcagcagtgacttgttcccgatccttcttatcggacactacttggcactacttcttcctgaaacgacatgtccatccacacccgcgcagaattggctccgctgcattttctggatgacatgac

SEQ ID NO: 4946 - DNA, 162 bp, Bacillus thuringiensis
ggtctaggacaagattttttttgctggcggggaacaatggatggctacgggcgctcctaaaattcggtacacccaaccaacagaccgatggtggagatccccttactacaaatgattcagaccccattcaagctaacgatccagtactttatttcaatcgcc

SEQ ID NO: 4947 - DNA, 221 bp, Bacillus thuringiensis
cggggtgaggcggctgttttatgcggcacgattacactggatggctacctgactcgctgccctcggcccaccggctgccgccagctggaatgatccgactcagaggccgccatactgctatccacataaaaacgggagaacgcctgaattatcaccagagcaaaatgccagcataaggggggcaaccgcaaagaggccacgtcacaggctgaatcacatag

SEQ ID NO: 4948 - DNA, 327 bp, Bacillus thuringiensis
gatgtaacggtgttggtaaaaagacgctactaaaaactttttcaaacaaaattctcatattgatacgaaacacgctctgaaggagacttatagagcctgcatacttttaaaattgtttcatattataatattgaacaccaattgatgatgtatggaatacattccctggtttgtacaaacttaacttttaccgccatggtagaaaaatgcggactaaaaaatgaacatatttgtcgcccatccaactgaaacagtgggggcgatcatacccgacgggtgggaaatgtaaaactaatgggtgaaggaaagtaaacttggctactattt

SEQ ID NO: 4949 - DNA, 108 bp, Bacillus thuringiensis
ctagcatccgcttctaccgttaatcgcgctgcttggacactttgtgtagaaccatgtgatgctgagtttcctgaggggtttgaagaaccgaaccaagtgtatttctta

SEQ ID NO: 4950 - DNA, 244 bp, Bacillus thuringiensis
aacatgccacttattgaggaaccgttgcacctactttttttaaggatgcgacaaaatgtggtgaaacctttgtgaactttattaccgctgctaacttgatgatgcgtattgctgtttagccacatacgaactttctaatagaatggacatgcgattccgtccaaagcgtttgtcatgacacagatgacaagggcatcaatctgatctggaccttacacggcagaataactatcgctgagagatg

SEQ ID NO: 4951 - DNA, 136 bp, Bacillus thuringiensis
ggaattacaccaagaacctgaaggaaatgttttttcaatcccaacgctgcatcaaacgttctttaaaacacatattgacaagacgaccattaccaaccaaattatggttagagacacattaatgattactaatcct

SEQ ID NO: 4952 - DNA, 230 bp, Bacillus thuringiensis
tctttgactgttcttcggatactgcgcgtaatcgaggggagtcaagactggaagcatgctaatggatcaaacgctaggtcacgccagctggtccttgggccaattgtcctcacccttaaagtatatacgcttattgctcttgtacaggtggcttatcagaggcaattttcagggaaaatgtgctcggaaccgcatattccattgtttcagataatccatacgatgtattg

SEQ ID NO: 4953 - DNA, 260 bp, Bacillus thuringiensis
cgcgctctcgtcggggccccgaacgcgagatcaatttcactttctaacatgctctcgcttaaaaaaagttttctcaccttgtacattcgctcgaaggataagtggcgcccgaacacttgttgacaaagatcgtagttcataccccctccttctctttgactcgcggcaaaaaggctcggcttaactccccggctcttaacgatgccaccgattgcggatgctactgcaatcctgtgcacggcttgtaatggcgacaaagg

SEQ ID NO: 4954 - DNA, 283 bp, Bacillus thuringiensis
gcacagcagacgtgatgactatgatccatgcagcgacgagcgcttgagcacgctcaatttcttttacgagccccttcaacggaatcatgaggatacctaactctaccatcaagggccaagctgagatcgtccatcttccaattgtcaaaggattatataatacccggacggtctctaaagcaacctagacgagcagagtactaaatgtcatctgtttcaccatatactaccgtaggggccgccaaatatcgtaagccaaattctgaaaagccccaacggggga

SEQ ID NO: 4955 - DNA, 129 bp, Bacillus thuringiensis
tcactttcactcaccgggtttttttgtccgtactggcctatgttctgatggggagagctatgaacatgctaatgctggtgaacactactatatccaaatagatgctaaagctgcaatctaaatgctatt

SEQ ID NO: 4956 - DNA, 251 bp, Bacillus thuringiensis
ttatggcagcactgcattatcgtacgatgcaaggctccttttcttagttgcgaaccattaggccccaaacgggaaactccctcattcatcaaacgacttgaccgagactggtttgccagttgccccagtgaggcccaagatcccaccattaatgaacgtggaccccaacgttaaaggcccaattaccgtctatcttggcgatggaccacttcatggaccttaccgctgttgaagtttagtggggtctctgc

SEQ ID NO: 4957 - DNA, 132 bp, Bacillus thuringiensis
ttaaaggtaataaataagtattgtaccgcaaaatgaagattaagcttgatgcgggaacaactaggaatacaggttctggcgcggtttaatgtggagtgggatacgatataacctgatgagatggtgccgcaa

SEQ ID NO: 4958 - DNA, 281 bp, Bacillus thuringiensis
gcttcccgaaggatagcttttttacggcagtacaatcattgcgtgctgaggaggcatatcaacagctggatgtgccgattaagtttatccaaatgcaaaaaaatgtaatttgacatatatatgctacgttctatcttcgtctaagttccacattatataaaaattcttgcgtccttttagaaaaacgaaagtttcttgcatgctggaaaagaattaattgcttggaaaacttatttgccaaaaccggtattttgatatctatctatcacgaatgggggcat

SEQ ID NO: 4959 - DNA, 264 bp, Bacillus thuringiensis
actttatcgcttgttcacttttttgttcactgacatgcaaagcttggaaaattggtttttacctgtttgattaaatttttttaataataaagtttcttttgcgggttttccttggttattccccaatatttttaagctaaattgggtaaggggaaaccttttttaaaataactctctattttacgtaaaggttttctgatgggtttagtgatttttatgccggactttttccacttattaaaggttttatttattattttttaa

SEQ ID NO: 4960 - DNA, 124 bp, Bacillus thuringiensis
ggcactctttatgatatctgccttgtaccttccagcatctgatttttttaccttaccagatgatgaactagaagagggtgaattatttgaacaataccttgggtgactccttgttgaacgactg

SEQ ID NO: 4961 - DNA, 237 bp, Bacillus thuringiensis
ctcataaatagcgacatctttatgtgaaggcttcgagttttagagacatcatgatacttttctttaccgctagtgccataactttgtcacaacgtgtcgtgcttgtacaagacatatgaaacgggcttttttgtatttagacggagacggcgtcggcaacacattaggaatatcctagcctataatagctgagtgacgaacctgaaagaattatggaggaacaaacaggagtggtat

SEQ ID NO: 4962 - DNA, 114 bp, Bacillus thuringiensis
acatgcgcggtacctgacttcccctatactgagaacgtatttgagctggccgcactcatggacatagatgattcctgagctgcaaatgaatgagctcactttttcacaggagat

SEQ ID NO: 4963 - DNA, 239 bp, Bacillus thuringiensis
taacggatccgcgcgcgcttttttgtgcgactatacataagacaatctgcataagaagtttcaccgtgcacagctaattacttatgcaacaactgatgtctaaaataagcgctagaaccgcgtcataaagtgcatgggcgcaggcgacactccaagaaaacgaaacggcttacatacaataacattgcgatgcatactcgctgatacaagactcctatcagatcatgcgcgaattgtta

SEQ ID NO: 4964 - DNA, 467 bp, Bacillus thuringiensis
gtccgtggatacgctaattagactctatcgtctaccgcgtatttaatgaccagaatacagctactgattcactgactgttgcataaatcatcatgcaaatgacagtgcctgagtgactttaagagctgaatcatactgggaacggcggattggcgtcataacgtgccaggagatgattcgacttatttcataacatgaatccacactatacgattacaaaagaggggcgccgtgctattggacatgcgtgggatacaaaaggaacgagtaactgcgcttgtcatagaggcgtaatgcgctaacgcggccatactctcttatcgccagacgctatgtattatgcgctcgatattaatggctgctactgtggaacataagaagcgaatcatttattatgaagcgcgcggtgtgaatgacatgaacacgtacgtgggacgtatgtcacgtgttattatataagggcaagc

SEQ ID NO: 4965 - DNA, 208 bp, Bacillus thuringiensis
gatttactctaaagatgggcttaagaggcccaacctcaaagtttgtttttcactgaagcgacagacccagcccggtcttttgcaaaacgttttgtcaccttattaccgtcactcgttcataatcaatcaatgctgcccatacttctggcgtgaactaaatatgcatccaccgtctaagatcgcgagcatcctcaacacatgccaatgg

SEQ ID NO: 4966 - DNA, 115 bp, Bacillus thuringiensis
gaatcacttaatgcagctggtacggcctgggctccctctggaccgcgcgcggggggccccgcgctcgtaatgggtgtttgctatctcgttacgcacctggggctacactctacag

SEQ ID NO: 4967 - DNA, 112 bp, Bacillus thuringiensis
acatacttaacaaactgaggtgttaccgcgaagctaacaactctcgtcctcaagatgactaatcttgggggtgggagcctttctctcccgctgcattgatgattccaccccc

SEQ ID NO: 4968 - DNA, 239 bp, Bacillus thuringiensis
atatactcaacgtgtctgtatagatatgcgagcgtcctaatggcaggaccttacgttttctttcagaccattctcggaacctatggccgattttttttatatgtttttatttggaagggtctctttagggttactattgtatcttgcgtcattttcatgactactttatagagtaagtggtataggtcttatgctatttgtatactaaaatttgtttttatatctttttcttttgagtc

SEQ ID NO: 4969 - DNA, 119 bp, Bacillus thuringiensis
gcgttctgtgtgttttgaattttgccatattcatatcattcgggttccaaggggtacattgttcttacttccgatgagttggaattgtgatccttataccaattcttacatcatcatta

SEQ ID NO: 4970 - DNA, 134 bp, Bacillus thuringiensis
acgcgcgtttttatcacacacaattcgtgattcaaacagtcctgactctattaaacttgaaatgcttcatttattatctgggggatagggttgtatccagggacggcaccttgtcccaattctcgttatggtta

SEQ ID NO: 4971 - DNA, 259 bp, Bacillus thuringiensis
gacactctggctagcacaaggatacgttcactgtcataaagatattgttctcgctgaagtttactctcgcgacacctgatgcatctgcctctttagctcctacaattgcagagatctctgaacacttacgtattactgacgcccatggatagataagcacttctggctgacttagatctaccatacatgcaacagcttcagatgctgctgctaccattccatccgacaatgacggctagctcaaactgcactggttggc

SEQ ID NO: 4972 - DNA, 117 bp, Bacillus thuringiensis
tcgacctgtatgcctctcttttttggatacactagatttacggggtccagggggttatatgaccattcaggacggggcatacggtttaccatctctcaatgatgcaacgaaaaaaat

SEQ ID NO: 4973 - DNA, 279 bp, Bacillus thuringiensis
gacttgactggatgacgacttgaactcggaattcccccacttttttggtggcgtcaaccatacgcaatatcaggcgctatcactaaaagaatttctcggatggaccaaacaactatcgaacctcttccctgcttgcgacgctcgggactcgctatgcatgtattacgatagatgttgctcattggacatgtctatccaggcgggacgcatatttatgcgcagactgtgtgtgtcgtacgatcacggatatgtatacctccggctgtgtatcttggggat

SEQ ID NO: 4974 - DNA, 115 bp, Bacillus thuringiensis
actcattctgagcttctatttttatattaacaacgccctactctttcaggaggatagtcacaaatattctcgaggttacattatttccacatgcaacgactacgtgatcataact

SEQ ID NO: 4975 - DNA, 117 bp, Bacillus thuringiensis
tctcattgagtgctgcctttttctacttcttctatttgataagcttgcacgaggggtgctagctactctagatgggggaaagaagcgacgaatctatattacactacttcacacacc

SEQ ID NO: 4976 - DNA, 167 bp, Bacillus thuringiensis
acacgtggtgtcagctgccacgctcgagaagcgcgcgacgacaaaatcagattgcagaaagttctctatcttttgccatgatacttgctcctttattgaagcggcctgcctatgatatagagttggagcgaagggacactgcattgattatcatgctttcatgcatt

SEQ ID NO: 4977 - DNA, 223 bp, Bacillus thuringiensis
actaaatgacgacaactccaattttttttttttaccaaaccgcaagcaagaacaccaggggtggggttgaaaaataaaggaaaaaacgagctccacctttacagcgaaaaaactctgtattgacgctataaataccagtcaggaacaagaaaaacaatcattactctgaaatctaaaaatactgttacatatgaattaatatagtcgataccatcttattaaa

SEQ ID NO: 4978 - DNA, 177 bp, Bacillus thuringiensis
gaaagctgggagacttttttgagcgaccttccgtgtgcgattgcaaggtcgcgctccgaggcagggcgggtatggaaaatgcaaacctccgtgatctgcctatggagagtaatattaaagctgaccgtggggttggatatatgtgtattcaattggaagctgccctccacacacagg

SEQ ID NO: 4979 - DNA, 322 bp, Bacillus thuringiensis
caagatgatttgttttttatctgcgctcaaacatatactgtattcgtgcctgtacgattgcgtgttctattctctggtcgcgcacgggtagaaaggtcttcttatcgtggctacccaaaattgaaaaggatctttttttacaagttctccctgcaggcggctgcatttcgtaaacatgattatcttgaatatttcccccactttactgtgatgatcagcgatctctctttcggagactctactgctgtggggctttctgttgtgcgtaacactggtgattttgtaggtaacgctgttaatctagatttacacattgctgaag

SEQ ID NO: 4980 - DNA, 139 bp, Bacillus thuringiensis
ggaatcactccagctaaattacgaactgcgaaaaatgtttttgcatttgttccagagactgaaccatccatgtgagagcctccataaggtggccaacatacgatggcaccacccgctacaggattgaagtctagcgctc

SEQ ID NO: 4981 - DNA, 237 bp, Bacillus thuringiensis
gaatacgcccaatttttagaagtaaaccatcaaacgcaaaaagggtgcccggcgttacatgcaagaggctccaaagaatgctaatgaaataggaggagtttctcaactcatattaaaggacgtatgaaacaaaatccaacagtaggggtaatcgatgtaaggacggctgcacgaactcaggaacgaatttaaaacctcaggatgtatcgagatgaacatccatatccacccaaataa

SEQ ID NO: 4982 - DNA, 152 bp, Bacillus thuringiensis
gattggagacagttccagtattagatccatgagcgtgagctttttttcttacatggaggaattcttttcataggcttgcatcatgccaatggcccaacgattcggatgattagggagacaggattaggttaaccaatctgttaacaggttgc

SEQ ID NO: 4983 - DNA, 216 bp, Bacillus thuringiensis
ttttcaaaggatttagggcagcgctgactcatagcgcacctactgcttaagacctaagcgtgtccacgaacccacaacaaatctgtatgagaccttgccggtctatatactacaaagtgctgtccgcatattgcacatattctatcattcgcgaggacggtaaacctatggactgtaacttttcccaacgttctaggatcttgtataggttggacg

SEQ ID NO: 4984 - DNA, 188 bp, Bacillus thuringiensis
cgagcagttggtataagcagggtgaaaaataccgtgcagtgttcccttggacggataccattgaccacatacccagccgcgtgacaaataatgcggcccatactgattctagcgagcgggaatccttctatcccattgggggacactacgactttcctctacgatgaatacttggtgtttctttcaac

SEQ ID NO: 4985 - DNA, 146 bp, Bacillus thuringiensis
gagtgaactttacagacttggaaattattttagcgacggatctcttgagatcttgcgcctgacaagttatcctgccgttagcggattctgtgggatctgaactttgggaagcgcgcgaagcggacaagacctgagtacttggatgg

SEQ ID NO: 4986 - DNA, 237 bp, Bacillus thuringiensis
tggcggtaccattgcatcccacgcccctgccgaccggcctatactgtttgacacctgccttccacccatcggctgcctaatgcccattgcgatggggacccctgctatatctcctttaacgaacgaatcatacgttcatcctttggccatgcgcccatgttcacagctgtaaccccttccccatgggatgacccagcgggcagatgtcctgacaatacgcatttgtgaccaccctgg

SEQ ID NO: 4987 - DNA, 188 bp, Bacillus thuringiensis
accccaggctttatctttttatgctgccggctatgctagatatgcggcactaaaaccgacctaaaagtgattccttaacattaagactgaaaattggcatagaagaatacggtaaataatgaaattccgctgtcgggatcacaggtcttatacccaattagctttaaatacacagcctgagacggcat

SEQ ID NO: 4988 - DNA, 234 bp, Bacillus thuringiensis
gctgcaaggcgaaatggatttataaagaggccacctcgcgtaccgagtcgggaagaaaagtgaacactatatcgctgctttaacttgctaacattaatgctctggccgaacaggctgatgaatagcgtatcaaacgaactgcaaggtcgggatgcggatgaccacacttattacgaatgtatctcgcgattaacacgcgcccgatgacgttctattatgggcctacttaccatt

SEQ ID NO: 4989 - DNA, 273 bp, Bacillus thuringiensis
catactaagaactcggcttgctaagagctctacataatctatttatctgcgtgatcacggatcttgaaggcggggttctaaacttggtaaatgaggcgatcatatgatgatctgacatgcaagctccacaaggaatacgaagtgcggaataatgctttcatgcgccggtttaatactacgtaaatggagccaaggccccatcctaatttagacgtttactataaagtctacttaagcaacaatcatccgaatgtgcctcactgtccaaggatc

SEQ ID NO: 4990 - DNA, 177 bp, Bacillus thuringiensis
ttatactcctgtaaatatgaattctgctattgtatactagccgacattattgctgtatttattctttgaatataatgtgtatttaaaatttacatatttggtttcacttttctcccttatgtttatgcatttttttttgtttctatatgctctataatttcctatttcctttttttt

SEQ ID NO: 4991 - DNA, 407 bp, Bacillus thuringiensis
tgttaagaccatcgcctgtttatttttctgagttaaccgaaagagctaaagagcaggctggagatcataaagatgttattgatgctgctgcaagagaagaggctgagtcagttgaagcatctgctgtacgagaagctctatcgctgaaatggagcaagcgattgctgctttgcaggaacaagaagattctttatctgttcgaaatgctttctaaagtatattgaaaaagaattaaaagatgaagatctggtgcacgtaagtcgctgattatatataacaagctggataagctgcgatgagcaatgggattgtttcggaacgaaatgctgtcgctcttttcaagatggctaaacaaaaacacgtattaaaaatgtttgaagaggaattactccttgtgcaaaacgttt

SEQ ID NO: 4992 - DNA, 161 bp, Bacillus thuringiensis
ggactgcgcgctacgtttaacggtgagggcgttgctaacattttgttcttcaccgccatgaaacttatcgactaccaccagacccatgatatgcgctacacgcactacattcatcgggacgcctactaactatctcataaggagacaactaacttcgagca

SEQ ID NO: 4993 - DNA, 617 bp, Bacillus thuringiensis
agaaagtagggagaagaaaaaggagggaaaaaaaaaaaaaagaaataaaaaagaaagaaagaaagttttattaaaaggggacaaaaagaaaaagagaaggggaaaagaggaaaaaaagaaaagaaaaaattagaaaaaggaggaagaaaaagaaagaaaaaaagagagaagagggaaagaaagataaagaaggaggaaaaaaaaagggggaggaaggggaaaaaaagggagggaaaaaaaaaagggagaggaaagaaaaaggaggagtaaaagagagaatgggaaagagaaagggaaggagaagtagaaaggggaaaaaggaaaagagaaaagaaagaagggaaggaagaagaaggaaaaaaaaaggaaaggaaaaaggagaaaaggaagagggaaggagagaaaaaagacaaaaaggggaaggagaagaaaaaaaaatgaaaaggagaaaggaaatgaaaaaaaggaaggggaaaagaaagaatggacaggaaaaagagggaggagaaaaaatgagagagagaaaagggatagagggagaaaggaagaaaggagaaaaaggggagggaaaaaagaaagaaaaaaatagggaaaaggaaaggaggaataaaaaaaag

SEQ ID NO: 4994 - DNA, 137 bp, Bacillus thuringiensis
tcagatgaattcacccggcacctttttttttttaagagcacaaaaatgccaatatgggtggatctaacagaagtgggatcccttacaccaggatttaaagtacttttaatttagtgtgtagctatgactaaagcttg

SEQ ID NO: 4995 - DNA, 406 bp, Bacillus thuringiensis
cggttctctattttgcagaacagggatgaacaagctacgttttatttttataacagagagcgtcggagcaatatgctttaaatatgagctaggttgggaatgctggagtgtaaacttttcgatatttatccagcacgtgatgaggccaagtaaatacgcctgccatagttagattcagcatatgctcgcacgccccattttttgaaagaatcaaacaatggacctcttttgtaaacgcatcacatacggatcgcatggtagattactaaagcattactgagacttcttagatagattgggaatatacatcattgacaaggataacgaggatgatgatgctgagctatttattaataacgagatatatatgatggtttcctggaggaaaactgtttgtattacataa

SEQ ID NO: 4996 - DNA, 324 bp, Bacillus thuringiensis
cgagcatgacgaactaagactaggatgccttatgagtgagttaaatcagagtaactgattcagagatgaagcgagctgtacaattgaacaaactgttgtgtcagctatatcgaacattagggcatccatcgatacgaggccggtaacatattgggcgctactatgcaattggtgtatatttgctcaaagacgttcgagccgttcttattagtagcggattcgatgacattcaatggcggttattcagtcgtccactttatatgcggatatcatcacattacacgagtgggcaaaatgtttaaaacaggctctgatgaaaagaga

SEQ ID NO: 4997 - DNA, 104 bp, Bacillus thuringiensis
ccataacagtggttgttgatcgcctagttccttaggatacggtcgcgggtgtaacatattcatcgtatgctcacgctgtatacctgaagagcactccaacggat

SEQ ID NO: 4998 - DNA, 136 bp, Bacillus thuringiensis
atgggtctcgcatgaatcacagtgtattctaagaactgtttttgttttttttaaagagaacgaccaacagacacgggtgggtgatgctcctatggggctgacatcgcccattaatagagacgtacatgctatgacg

SEQ ID NO: 4999 - DNA, 263 bp, Bacillus thuringiensis
catgggttattcatctcacttcttacctgtttattcatatattgcagttgccgctagttatagaagctaggtactcattatatatagccccctagatggagcggtgccatgaacagactgcttctggtccattcatacatggcatacttgtgacgtccgtactcactgctcgaggcgctagtcctggctggatctccactgcggaagctttgactgcatatcgcagtgagagtccttcccattgggaaaaagaaattcttgct

SEQ ID NO: 5000 - DNA, 185 bp, Bacillus thuringiensis
tcggcttaagcgggaccggggctgaccaagctagcggttaatttagtactggcttctatcctatcagatctacgtgtgccatatgctatatcagaaaagggacatgctttacctgctgttaaggatgcggatcatatggtggctatgcatgcacaattgcctgatctgggagcgctataagctgg

SEQ ID NO: 5001 - DNA, 203 bp, Bacillus thuringiensis
gaggacgatctaagagcttcacactcaatttacgagaggaattttttacataggatcgagccaaacatagaccggacgtcacgtgtaaacttaggtcagccacatatcttacagctgtagccgccggcctccatacaaatgaggtaatgtacctaccttctgaagcctaagcttggatgacgccaatcagtggggggcccgta

SEQ ID NO: 5002 - DNA, 197 bp, Bacillus thuringiensis
cgagatatgaaagtgacccacactcttctgcacgaaaaggcagctttttatcgcatggtgcatgcaaacgagaacttggaatgtattgtactgtgttataccctagagggagagaatgtgcatcgcggccattcttgtagcaattgatgcgctgaaagtctacactcgagactacaggaaaccttacccttgaataa

SEQ ID NO: 5003 - DNA, 282 bp, Bacillus thuringiensis
catccgacctgctacacgtagcagccgaaaaccacgacattattgcagtgaaaatggagaggaatcaagcgaatttcatgaagatcacagtcatcaaagacgtgttaataaacaaattggggaatcaacataccggtggtgatcacctcaattaaaaagagagaagtgccaagttgacaggaccctctactataagggatttgaagcacaatcaagactgtaaagtgctgaaagggcgtgcctactgtgttaatcgctcagtcaaactacggaaagacaatt

SEQ ID NO: 5004 - DNA, 218 bp, Bacillus thuringiensis
tcatatagggggatttatcagaacatttcttaaagtattatatataaaccactacatcactgaagtattgtggatcatgcccgattgaagaaggccacagacggacgtaactctcatctcacttttttacgaacagataaggatggttccctaatggcagatactcatttataagcaatggcttgaacttatttatcacacacagaacacatcttgat

SEQ ID NO: 5005 - DNA, 276 bp, Bacillus thuringiensis
ccactcttaattcgggagcgacacattgctgaatgaattattttgaaacgaaagcatccgcgaagggttgtagaacgtgcccgcttgaacaaggccacggatggtcgtgactatcatcgcattttagttcgaacagtaagggagggttccctaatgtcaaacactcatttattgccaatgacgtaaacaatttatcacgcacagaacacagcttgatccttgagacacgcacaaacgcaacgatattcttagcgctttgcagcacactatcaagac

SEQ ID NO: 5006 - DNA, 125 bp, Bacillus thuringiensis
cacccttcgccctaagaaagactgggggctcattaaataggacagtaggtaccaacacagaaccgagtacctgttgggacctatcgcaatcctcatgggaggaccaaacatctgaacttgaaaaa

SEQ ID NO: 5007 - DNA, 226 bp, Bacillus thuringiensis
tacggaatcatcgttgttatactctctcacatcaataataaaaaagggggcaaagggtagtaaggcgaaaaatcatccgaaaagctaaccttccaggttagacaaaatgaagaagttcatggtttttttcagcaagaatcgacattcaatctatgcaacaagcaaaccgaggatacaatcgttgggatttttccattacttttcgccatattgtaacgcttctaat

SEQ ID NO: 5008 - DNA, 228 bp, Bacillus thuringiensis
caaccgaccaacctggcggataagctgttgaagaccattcttctccggtagaaacgaaacgatccgcatgggggtttattaccttaacagcgctcccaacatttctaccaatcaacgaggaattgtttaaagcacaaggagaatacttcacttgacaaaacaatacagtcttatacaacggaactcttacactaagcgatagccagcaccgaactccgctttaaaatc

SEQ ID NO: 5009 - DNA, 181 bp, Bacillus thuringiensis
agccacgctcagaagctcgtcgacaattcgatcttcccgtatagaagcttatattccgctatttataatgccggagactgggggtaaaacttcttcatgatatatctctgtccccgttactaacgattcaaacgctcttagttaatgttccatcaagtctaataaactgccgaatcatttt

SEQ ID NO: 5010 - DNA, 268 bp, Bacillus thuringiensis
gctatttcgaccgcggagacagagcatatgctcgggacacttattcacgaatagaggcatgtgagtgcaaaagagctcgatgcgtaacatccggcgcatttttatacaatcgggcaaagtatgattccggtaaaggctggggcggagagggtatagatggacgttaacatgacgatgtcttaaacgactaatacgaaaagagacgaaagccaggaatggactactctgtcatagtaggaggaaggctactcgagtgatgaggccttta

SEQ ID NO: 5011 - DNA, 294 bp, Bacillus thuringiensis
ccaatttattacttgcaaaatatagcagctgattttgatatgaataatcatttggagccttttataactggattacaagaattagaaaggatagatgctgtaaataaagttaaattagatttatattttgataaacaattagggcacatccctttagagaagaataaaattatgccatatatgaaacaaacgctctatgaagatagaatattgtaattaaaagttgagaatctcttcatgtatttgaagaagtttttacctctttagtttattttatctcactatttgcgggca

SEQ ID NO: 5012 - DNA, 195 bp, Bacillus thuringiensis
atatagcgagaatgtgcgattgtccaatgtgtcacacccatatctgctcggggttgcaacacgtgaggcgtactatgtcaaacctgcagaacagtatactggttacgatggaattgtatgtgatgctgggtatccatggagtaatcccttcaaagtcgtgcattcacattgcgctaggtgataccactcgcaaga

SEQ ID NO: 5013 - DNA, 231 bp, Bacillus thuringiensis
accacttcacgtgaaataccaatcgctacccattcacatttatgtgtagcatcagcgaattgaacatctagttgtttaactagcacaaataggtccgattgttgcccaaacatggagtgaaaaccatgcaattatcccaaaataattacttgacaaatatcatggagcgctcctattgattaaatgacttcactctgataataattgatgtgtaactaggaccataagcgc

SEQ ID NO: 5014 - DNA, 284 bp, Bacillus thuringiensis
acgcgtgttgtctagctcgccctcgcgctagaggcgcgtggccacatacacatacagggtaagaacgctagttttcactgtacttgaccactaatacctcttaggctgtcatcggtgcatacttaagacatctggcatgagaggaaacccaacttttgtgaagggaggcttaatgtctcaactaaaccataccgaataacactcactatagcgctagttcaagaccaaactttctatcgagccgcagatgcccgttcctaaccggaatataatgctgactgcgg

SEQ ID NO: 5015 - DNA, 221 bp, Bacillus thuringiensis
cgcgttacttactgcggatccagaccgcgagatagctttgtaacactattatctgaattaaacaacaagctttttgtatggctgttatcaattgaatatagggggggggtactgggtccgcaatagagtcaatggaccgttattataacaaggagacacaacccatgatctggattactacaaacgctagacacggaaatggttggtgttacacctgttaa

SEQ ID NO: 5016 - DNA, 226 bp, Bacillus thuringiensis
ttaaaaacgaggcccgaaaaagatgccgcttcacacatgtcttttcgtgacgtaagcgggcgagcatttcgaggtgtctcttcacttggagcgagcgatggtatcctgccagacactatctctctaccagatgcgggtgatcgagttacagactcttatgatgcgtaagaataccaccgccgatgactgagtgttgccattacacgcgccaaagaagaaccgtaca

SEQ ID NO: 5017 - DNA, 227 bp, Bacillus thuringiensis
tgcaaaacctaaacctatactaccaactgtcgccggtccaatagccgggggtaaagctcgaagagttgtttgatctggaacgacctgcattacttgcactatatcaccatagcgcttcgattgatcaggtaatacctgaatgacagcacccgagtgtggaaccgacgctgccaccgactgactccgctttactggactttctgctactttcccaccacattcagctc

SEQ ID NO: 5018 - DNA, 351 bp, Bacillus thuringiensis
tcaagctgatagtaagggcaggctcgtggctcagcgggcggttttgccatcaaagcatgaagggtggcacgctgggagctcacagagaacatactcgccgtcagcgcatagacaaggcgccggcggccagaccagacagaccaccaatacggaagggcgaacatgatgattgtatcattctcttaactaaccctttgatcgcgattcctgtaaaggttctcttcaatactcttctaaatgaatttctcaaaaaatatcgataaaaagtctttggcccgtaaaatgttaccgccaggatttgcaattcaagttcgaatattttcctggggaaccttccccattaaaaaatta

SEQ ID NO: 5019 - DNA, 246 bp, Bacillus thuringiensis
gtccagaattcgcgttcagggtatgctgctaaccactgtagtattccgatcgttaaagcttggttgtatgcgaaatcgcacagtgaacaggcgggtgcctcgctctttgctatttaacgtgccgagcgtatctactccacctgctgcaagtctaatggcgccagtgtctggctggaatacgcccgcctttaataatatcttgtcgtagcaaacctagttcttcagaaactattggcattattaaat

SEQ ID NO: 5020 - DNA, 183 bp, Bacillus thuringiensis
aaccagtcaatataacccactatcgaccagatctctacgcaattgcaaacccgattgggacctaccccgccctggtaagacttgtatgctatctgaataaaatgcgcgatccataacatcgtgggagtgcgattaatgatgtattttccgcgcgctgtcatcaaccgtgtactggcacaaagg

SEQ ID NO: 5021 - DNA, 224 bp, Bacillus thuringiensis
cttacctgccctcatactatcgatgtcagcatcctgttgtcctccatttaaagctgcatacgaatgattaaccgataccgatctctcactgagtttaacgtgtgcagctgctggcccgagtccacgcaacatgaataatgttgcttcatgacggacaggatcatgtgccatccgaccttgggctacatccctaatatgaccatgcctcggcacttcaatcggta

SEQ ID NO: 5022 - DNA, 234 bp, Bacillus thuringiensis
gctgcatttcccactccagcgactgaaggagcaaacttttgtattaagacggttgatgcgctacataaagttggccttccaaaatagtactatgcgaacgctatgcctggacgctgttacggaattggggactgcatattgcaccacaaaagcttgactttggatacctatacaggtggctcgtgccctgcgaaccccataaagtatcaagcttttttgattcacatattgtaa

SEQ ID NO: 5023 - DNA, 148 bp, Bacillus thuringiensis
cgccaaacgcagtgatttttctccacaccataaacgccaaaagaaagggggtgattcttcaagggcatcaagtgcgggcatttgcccccgcgaggacaagcccccttctacctacttacgtcaggccggctctagccgataacacagg

SEQ ID NO: 5024 - DNA, 193 bp, Bacillus thuringiensis
tgtaaagctgcatgcattttttatgacataaatactcagcctaatgttgcgggtacatacatcatagcattatgcatataactactcatatggacgaggtttaatgcgatttaacggttctatattacttacaccctattggggcagtagattccatgaaccggcacaacccccgcttaataaacgatgagac

SEQ ID NO: 5025 - DNA, 268 bp, Bacillus thuringiensis
ctctagcgattgctgtcccttcaggcttttcactcaagtcttcatcagtagctcgacccgttaagaagtctggcccactagcaatcgcaccgcatactgcgctactagttagatgcgcaatcatactttcaaatggttatcgattagataagccatttcgggcatgcaggctagttaccagtccagtgactagcgcagtcgctaagataaatctcagttgcgttgcgatagctctctttatttgttgcttcggtgcaccaatatttat

SEQ ID NO: 5026 - DNA, 239 bp, Bacillus thuringiensis
catattggaccccctgctctttttgtagcaaatacgcaattgtaaataactgggggggcggatatgcacctgtaagtataaaatactcatctgcacaggtggccctttgcgcaactgcaaagctcactcaatataatgcggcttcacaaccacatagctagcggtttgctaataccataaaaccaataagcccctgagacatgtacataggcacctgaactttactcccctaatgggat

SEQ ID NO: 5027 - DNA, 241 bp, Bacillus thuringiensis
gtccacagattcgcgagatacggtccatctgcagttgagaattagctgctgataatttatttaaaggcgatgctaacgtattcggataaaggggcattcatgggacatatgttcggacactcgtatcaatagatttatgcgggcgtcgcatttctatttaaagttgcaagcatactaccaagactctctcaacatacacgagcataatgtggcggcaaatctgttactaggactacacaaa

SEQ ID NO: 5028 - DNA, 221 bp, Bacillus thuringiensis
caatggcacaacgaacgttttttttaaccagtaaaatcaactggtataagggggaattatgaacctgctatctgcagatagtcctcatgaaaaactcgagtcctcgtttcatctaaaggaatggtcatctatgttgccttgtaaatgtgagactcatcatgatttcttaccatccagtgaacaccaatgccacccctatattcctaatggattcggccgta

SEQ ID NO: 5029 - DNA, 189 bp, Bacillus thuringiensis
gggtgatgtaacacgtgggctacctgcccataagactgggttattctccgggaaaccgtagctatataccagattacatttatgaaccgcatggttaaatatagaaaggcggcttttgcttgtcactaatggatggacccgcatcgcattaattagttggtgaggtaatggctcaccaaggcaacgatg

SEQ ID NO: 5030 - DNA, 106 bp, Bacillus thuringiensis
tatccagccagtccggatttgcttcggcctcattatggtcctcatattagggcgcgcctcttccaatcttttgaaaccttgcctgtgacttaaaagaatgaaatgg

SEQ ID NO: 5031 - DNA, 212 bp, Bacillus thuringiensis
aacatctagcagcgatttatgaataaactgggaaaactactcactctgacagaagggtgcgaggccttcaacaccgtattaacctggacgaaaaaccactgatggtatttgatgaacgtgaatacactgtttaaatgaatgcaacttgatctattgcaagtgttatgaaacaacaggaaacacaaagcgcgctgggttagacgcttggagag

SEQ ID NO: 5032 - DNA, 128 bp, Bacillus thuringiensis
attaaatggttaaaacattttttttagtgagggctataagagagtcttagaatgaaatgttaaagggcctacactttataatactatattcaatatggttaaattgagtaatggttctttatcaaaaa

SEQ ID NO: 5033 - DNA, 194 bp, Bacillus thuringiensis
gcaggattgaatcactattcttggtcctgacgacgagcgatactatagaagaccctcagaacggatgggattatgcccgacatgactatatcgataccccatgtcacgccctggaagcaacatcgagcactctcgctttactaccctgacgctgaccggataacatcgccgccttcctaccttctagtaagcgg

SEQ ID NO: 5034 - DNA, 214 bp, Bacillus thuringiensis
caaacgtgcagaaagtatttacatcgaagtaatggtattgatggctcggacttacctacttagagacacttacaaggtaccattctaatctatcagagcacacgaggcgtaaagcatataccaaagactcacacacacatgctgcgaacccttgaaacaagcgattaacgagcgaagggcgaaatgctctcacacgggagtggcatggaaaagg

SEQ ID NO: 5035 - DNA, 196 bp, Bacillus thuringiensis
tacatttggcatgtgcaatttttatcatagagtgcttactaatccgatgtggggcgtctttggggaacggaacaggattacgataaccgaatgaggaccgagatagcctcttatcatttatacgtaccgtggacgatttaggcacgaaacaacgccggatagatcctatgtacgaaggcgatattaccattcagcc

SEQ ID NO: 5036 - DNA, 389 bp, Bacillus thuringiensis
aatttcaaataggtgaaaaaggaatttttggggattttggggcccccccaggtaaagaaggaaattgtggggattttggggcccccccagggaaaaaaaaaaatggtgggaattatggtgcccccgcaggggaaaaaaaaaatggtgggaattatggggcccccgaaggtaaaaaaagaaattgtggggattttggtttccccccaggtgaaaaaagaaatggtgggaaatttggtggccccccaggtgaaaaaggaaattgtgggaattttggggtccccacatgggaaaaaaggagattgtggaaatttttgttttccccaattggtttaaaaaaaatggtgttttttcccaaggtcttcccgccaatattttaaatggccaatttt

SEQ ID NO: 5037 - DNA, 174 bp, Bacillus thuringiensis
ctcctttagcgagtgcttttgcacttgacatatgaggcttagccaacgcgattataaatgacggttctacaccggcagattacttacatacccaaagagattgggcctatagtccatacttggaaaacgactttcctgtatagaaaaatggcatattatttgtaaagaacaata

SEQ ID NO: 5038 - DNA, 325 bp, Bacillus thuringiensis
ggccccacacgcgtgtggtctagctctcctctgcgctcgagacgcgtgtacacaaacacatagctgcaaaagctgacagtgtctatccaagcttatcattgatggatgatgcgcaggaattatttattcctgcgggacaaaaagaatggactgcatctccattatatcacaagatttgcccatcgtgagcagattacagatgagctagattcttgtttacgaaaatgagagacgagcgatatttgatcagagaaccctcacgtactgaacgacatacttgaggcgttgtatgtatgaagaagggcgcctgttcatatattgtatt

SEQ ID NO: 5039 - DNA, 107 bp, Bacillus thuringiensis
tattcatacgaatgtgtttttgttatttaggatacccccgtacttcgaggcctgtgctattttgtcattacgaaacatacgtttgtaccttttctgttaggatatgg

SEQ ID NO: 5040 - DNA, 397 bp, Bacillus thuringiensis
tattgaataaagagttttttaggatttttgtgtcaccgaaggtgacgaaagcgaatgtatggaatatggggtcaccgcaagtgatgcaagaaaccgttagaaatatactgctgccccatgtgaaaaaagcagatgtaggatatatagtgtcaggcgggactgaagaaggaaaatgtagggaatatagagaccccccatgtgattagtgtgattgtccgatgtatggtgtcaccacacgggatgaaggaaaatgtgagaaatgatatgtcaccacaagtgaataaagataatgtaggaaatcttctaacgccaaatgccatcgaatgaaaacgtaatcattgcacaggtcattccggcaagggttcaactgccaaatttattgccaatcaggggtaac

SEQ ID NO: 5041 - DNA, 117 bp, Bacillus thuringiensis
atataccagcgaccaccctttgtcactagaaaccccgctctttaacagggtactcatagctcttccttggccgactctcacccactagaatgatctataattttgagaaacgatggg

SEQ ID NO: 5042 - DNA, 136 bp, Bacillus thuringiensis
atcaagaagcattacactttttttgcgtctatataatgaaggggcactccagtctaaataacaacacgcctgggcgcgtatgtgatctggatataatcattcaatatactaattctcatctcgacatgttgccatt

SEQ ID NO: 5043 - DNA, 190 bp, Bacillus thuringiensis
acgctcacaacattagacgataatgcttcatataccgccttttctatgcgaaacgggtcccaagtcctgacatccaatgtcatgttgtcatatgaaccccttcgctatacgccggatcacttttaaagaccacctgtatatcctagaaacatccgtctatactatcataacgagagagaactatggataa

SEQ ID NO: 5044 - DNA, 228 bp, Bacillus thuringiensis
atgaccgtgtttttcatcaacctgttcaactgccgaacgaagtatgccagccacttattcatcgtgcccaaaatgaattcaacatgtatgatagacttatagaaggtgacttacgggcgcttttctgaaagtcacaacataaaaactggtgacgtaaacgcacgtattaaggactgatagaggagcgctgggttagctcagctgttttttttagattcttccattact

SEQ ID NO: 5045 - DNA, 240 bp, Bacillus thuringiensis
caattcatcagacttactcaatatataacacggagtttttttttaattactcacgacacgagcgggcggatggatctactaagacccagatcggagtatggacattattactgagaaggggataaaaatgcacttgataggggaaagacagcatgctatatagacgagagattataactcttatccctgcagctaggctacacatctactatcacaggcacaaggttccaactaccactc

SEQ ID NO: 5046 - DNA, 145 bp, Bacillus thuringiensis
tcggggggagaacgtggacttcttgggcaaagatctcgagttcttaaccatgtttcttatgcctatgctagctctttaccacccttctggtggcccgagctctccgtcgatttgttctatagtcgtcgcctatttggccgcccat

SEQ ID NO: 5047 - DNA, 349 bp, Bacillus thuringiensis
ccgagcatcaccggaaatccccagactggagatccgaaaattttatataccccttccgaacgatataaattatcagcttctgcatataggaccgatactctacatacgcttgccaatgttcggtccatctctcccactatagcatactacacatctcctttcggcagtgatatgagccacgctgaataatatatgtctaatggaagacacattactggctgagtgagattgcattaattgccacctccctatacgagcggatcatcgtcggtggcgctgaagacgactaaatgatccattttactctccatctcagtgtacagtgacgccaccacagcgatgctaggat

SEQ ID NO: 5048 - DNA, 217 bp, Bacillus thuringiensis
tgattgttcgaattcaacgcgatatgatccgtacatccccttttttttcaagcagggactgaccgtgtatcagggggacaagtacattacccgtcaagcaaacccccccatagtacataatcgctacaagtcaagtgctcatttattgtagcaaaaagagggcgagcatctttgtgtggactgcctcgtaacccacttggcagagctttagacatat

SEQ ID NO: 5049 - DNA, 201 bp, Bacillus thuringiensis
ggctatataccgcacgtgagggggctagcgcccgcggccattcgatcatataggggcacctcttgggccggacaattcacatggacgggttttacaacagggtgacggggaaagcctgggctgtccgcatgttattaggctcgacgcacatgacactatccacagctggagttatacctaccaggcgcgcaccgatggccc

SEQ ID NO: 5050 - DNA, 171 bp, Bacillus thuringiensis
attatctgtgaccagtttttttggcatgccgatcacattatttaaacatagtcctgacgccatacgaattgcaatacctgcaacgatagctacgaacagagcatgcactctaaatgaaaagcctctcagccactaattatttccccgaataatatagagccaatgtccaac

SEQ ID NO: 5051 - DNA, 183 bp, Bacillus thuringiensis
atgttatgtgaccaaatttttgtttacgcgcagcacatatcataaacatggttccttgacgccactccattaactacacctgcaaaccataactactaaaagtgtatattttcacatataaaaagccccactgaccactaataataatcgccgattaatttcaccatattccaactatcttcc

SEQ ID NO: 5052 - DNA, 137 bp, Bacillus thuringiensis
ataacctgcactaggtactatgttttcacccaaaaaaacttcttctatgcggggatcctttgttgcttttatgtggatcacctatactttatgagtctaaagccttatccataaaatatgccctgtaacaacacgga

SEQ ID NO: 5053 - DNA, 241 bp, Bacillus thuringiensis
gagagtccagctcgggtaattcctggaccgtgtgcaaggagacctactccggatctaccggtgcggatgccatacttggcgaaatgtggccttcttcctccgggggcatcactgcatgtagggtgccatccgacgtcattgcttgcgatgactggggatgtggacgcacatagaccgcagattatgcccgcgccttcaaatcaagcggaaagcttcaccgtcagagaccatagcgcgcatg

SEQ ID NO: 5054 - DNA, 383 bp, Bacillus thuringiensis
attgcacactgggtcctttttgtagaatcaagatcgtctgtactgcaagtgctgatgcctcattcgcaagccagtgaccgcgattgttacgtgacaaacctaaatcggcaactgcatacactgtcactgattgctgtaaggtgtgcatcgatgagagatggatttgatgtatatattacatgattgctggcggcattatactccagctccttttctagagcgctcagttgctcacattcgaggtgtctaatgcgcactgaggcgtctcgtgcataactcattactggtgctgctgcaggcttccataggtaccagtggctggggattcctcttgtgatagacgagctatacccaatggcatggtgctgaggtcggactaacca

SEQ ID NO: 5055 - DNA, 257 bp, Bacillus thuringiensis
catactgaggcgctgaacagccgacattgacagacggaagttttactgcgatccgatgacatgaacgacctttgatgcaaatactcatatgttagcactaagcgaaaatgtagaaattgttcgacagtcgttctgtctccgtctagcctaactgacgaacggcagaatgcattccgatagaacgggatctaccggtattctatgagcagcaacttgaccgctgtagaggctctatctctaatttaagaagcgaacta

SEQ ID NO: 5056 - DNA, 195 bp, Bacillus thuringiensis
gcttcctaaaaacgcagatggctctgtaaatacgcctcacatcaaacctagacctactgtaatctctgcccattgcacttaacagctaggcaggtcctgccttggaaggactaaatgatgcacgacctatgcccaccccctctttactgcaaggtggtccccagatgcaagcgcaaatgctggcgatacaaagcc

SEQ ID NO: 5057 - DNA, 351 bp, Bacillus thuringiensis
gcattactgaatgtttcttcccactgagtggggctgcctgcaaaatgggcagctaccttgctttgtctttaacagactagacgccgtttttataatgcggcttgagcagcctatgggaccaagaggcgtggtaattgtcacttacggaattacagctgtaatcaccgattcagcatccgacacaaggcccgtttgcagcaagcgtcgtaccgagggttgcctagattgcgtcgtatcataggttgccgccaccaggctagtaactgatacatgtatgataaagtcagacgttgacaatcccacgcagcctgttaaccggccacgtgatgtggcaagcctggtgcgtctaac

SEQ ID NO: 5058 - DNA, 443 bp, Bacillus thuringiensis
gtagatagatcgattcatatttttagtgaagaatattcacttgcaattattttagaaaaagaacttaccgctacaaatgcacaaataattatggcggaaggtcaacttgatgaacacatttgctacaacaaatgatatcaattgaaccgagtaactccagcacaccaaatgtttctggatactgaacacaggatgcctctaaagaatgagttcaaagagtcattcactaaggaacgagtcctagatccattattgaagctcatgaactacctatgaacatccatattcaagtggatgttggattttaatatgataggcttaggcgcgaaaactgacggaagccgtgattgattgaaatgcatttgctgctggagcacttgctgaaagaatacattaatagtttgagcgtgatatggaaaatttggcagaactaaattctgatc

SEQ ID NO: 5059 - DNA, 164 bp, Bacillus thuringiensis
gattccgaaagatgcagctggccttgctaatacgcctacttttaatcctagaccgactgaaatttctgcccattgaactacatagctaaacaggtctgccactggaaggacatattgatggacgaacgctgcccgcctactttgtagtgcagcgtggacatctg

SEQ ID NO: 5060 - DNA, 306 bp, Bacillus thuringiensis
ctacagcatgcctgcgaactcagatacaatcgctctactaattttactccacgaacgaactaacacatctcccggtgggatgaaagactcgtaaatgcaaatgccctcggtagcgcacgagcgaatgaacatacagttgcagtattatgtacgacagccacgcaatgtacccactactgatccactggatgtcaagcttgcccatcgagacatccactataacgccatagcgcccggatacccggatgaagaaccgattgtcggggacattgatcccaacattcatgctcgtcaatccgatgcgtt

SEQ ID NO: 5061 - DNA, 403 bp, Bacillus thuringiensis
tctattggcatttcagtgattctacagctctactataacatgagaagaaagaacgttctcgaactgcgacaataaaaaatcatatcaatacctaaggatatgggagtttccattgtagaatgtggaagggagttgacgaacctctctcgagcgaagcacggaatatcaccgttcattgacacagctgattgggacatattgtatactaccgtagaactatccgatttgtccgctccttgatctattgccattgcatgtcatattatagcttgattaatttagtctgcaaagagaggaggcatcccactgacagcctgtattatccatattgtttgtaggcttattattgatccagattacaatgctcgactatggattattttggaatcaaaatgggaaacgc

SEQ ID NO: 5062 - DNA, 187 bp, Bacillus thuringiensis
gcaaccacctattttttttttgactggaacagtcggccgacgtgacggagcagtgccagggctataacgttgaacagagccgagacgctccgggcgtcatgtgataggggacgttcgtccacagctcgtgcgtaaccaatcacacgcagaaattcttcatgcgcggaatactgaggtgcgatcagtg

SEQ ID NO: 5063 - DNA, 211 bp, Bacillus thuringiensis
atcaccagtgaatttacaatcaatctctttcgattgttttttacctcctgccggacgaagtggtgatagcattcgcattacggctggcaaatgaggaactaacacatacattcattaagtagcctggggctgatgtatgcctttggaaccaacaggtcctttatgcgtaacactagaaagctctatgcccgacaccgcaaatgggtcggta

SEQ ID NO: 5064 - DNA, 359 bp, Bacillus thuringiensis
ctggcagctacatgtttttttaaatgtcttaagacaagagtatacactcagattcaaccatgacatactgatcgtgtacaccgtggaaaattgatcgctaaacgtttgtacggtgctgaaggatatgattcaaaagctggaggtacacgcgatggactctcgctcgcaggtcttgaagaacacgggcgcgacccatacagaggtatccacgtaggaactcacagaggaatatgatgatgactcgacgaatgcagcattaaagactgtggagtgcctgtaatagagcttctatacggggaacaccatttgtcgatcgggattcgatctgaacgcaacggactgatgatcgtgccgaaacg

SEQ ID NO: 5065 - DNA, 145 bp, Bacillus thuringiensis
tttattatatagtaccgaaaaggttatacgcgaacatttttctgcattgttagatgaacctactctggtgtcggaactatcggctcaatcgaacgaaaaaccactatttgtgattcggacgtgagcgtatggggtcgtggctgaa

SEQ ID NO: 5066 - DNA, 215 bp, Bacillus thuringiensis
caatgcgtgaacaaactgggggacgatataatataaattggttaccgttttttttccgacatcacatagtgtatctcaatcatgggtcgatatgcctgtggtgccgattgagtgatctatcttacatttattgcgttaccctcactgctcgctttcgcctcaggaaacctgggcagcctcctttattaaagaattggacatcgcgctccgtttag

SEQ ID NO: 5067 - DNA, 331 bp, Bacillus thuringiensis
gtgcgagcggaagactgtgtattttaggtgtatccgctccgacatataccgaaatcgatgccattaaacagacaggacgaaattatgatcacatctctgataaacttaatcaagcctgaagaccatattgcgagactcctagattcataggcacacgtacgatgtgaacataccatccatcggcattgcgcttgctatcgctggcgctgagaccgaaggaaatctccgtacaactgaaagacttgatcaagaactaatcaccacacacgatgtcacaatgataaaacgtcataacgtacaagacggtgctccagttgaaacgatgatttat

SEQ ID NO: 5068 - DNA, 343 bp, Bacillus thuringiensis
gcatatgcatggcaaacgccttaattgctatgagcatacatctgaatgcaaactgtaatagcacatggggagatcctaatatcacagacatgcggacgacaacgttccgtgtaatcatatccaatagtactcgtggaaacgacggcattccgccgagaaaatacgtaacctccgactcggaatagaacggttgctgtcacgtaccgccggatgtgcacactctgtacgccgttatgtggatagacagatggccatgcgcggccaatcacgatgacagtatgctctatatacaggagataggctgggaggatatggggaccgctaatgtccaacacctggatct

SEQ ID NO: 5069 - DNA, 237 bp, Bacillus thuringiensis
acggttcgatacaaatataaaaataggctgttctcttttttttttcggatcgtgaaaaatgctctcggacggggcgccctcctaagagcacattgagtaaactaccgcaactacacctaatgcgtatttgacgctggtgtcttaaaaacatgtgcacgctcattaacgtcgtttcatataaaacgttgggataaggatggactacagaactaagtcctgtagcggctagattaatat

SEQ ID NO: 5070 - DNA, 499 bp, Bacillus thuringiensis
cccccccacggggggtttaaacctcccctgggctcaaaagcttggtcgccaattccaaatctttggaggtggagaatttttaaccccgggggatttgggggttccaaccggggggtttaactcttggcccgttttggccctttgaaccctggggaatatgcccaccttggggagggggtaaacccacttgttagggctttttgcgtccccccaaggggctttttggggtttcccccttctttatattggggaaataaacgggtgaattataaagaaatttagtaacgtggggttttgggggaaaaaatcaatcccgttggttaataatataacaagggtggtggaaccaatttttcctgttacgggttggtggcctttgggggcttcccctgtaggggcgtttccaaaaaaaaagttcccaaaaggggctaccttggggggcccgttattataaaatggggggcctttttttcctgaaaaagaaaacccggggttcctg

SEQ ID NO: 5071 - DNA, 297 bp, Bacillus thuringiensis
gtattggatgtaacggataaaagtattcccaagttgaaaaattcatttttggttatttatttcatggcgtaactgatttctttgaaaagaagagattaagaagttcatactttcaaaccttccctttcttcgaagaccaaagaatgtacgtccaaactttattgtcactaaaagaaggtatggaacttaatgaagtggatgtttatcgtacttctagtctttccggattaacaagtgaaggcatgccctatggggacgcaaataacctttcttaccttcatggctttttaaaaaaac

SEQ ID NO: 5072 - DNA, 302 bp, Bacillus thuringiensis
aaatagtcatgagcgacacttaatgcttatttcttcacttactctgacaggccgttcgtctcagtttgactcataccatcgccgctgacacgaagcgcttatattgtctcgaagagtacatctgctagttggtgcgacgtaaaacgacaataccatagatggagcttattacgaacgcttaattctgctaatggtttgccttgatgagctacatgctttacgtactttccttcgggatggactatgctatgttcaaacttcccgtacgctaacactaagacacagggacgtcctcgaaaata

SEQ ID NO: 5073 - DNA, 468 bp, Bacillus thuringiensis
cttacatgatgttcttgtcgcaggagcagatccaaccgtcagaatggcttgatgctgcataccaccggctgaaagactatgtgcgacactggacggagctgatcactctatgccaatcgtgaacgcaatgcggtaatatcaggccgaattggctttacttcattcgccgaggcaactgctcgtataatatgtcgcacaattacgaggaattgcgctttggcacagaattcgctggctatcggtatctgtcgtctaggcgcagtacatggcgcgcggacgacaccagcgaggggatacatatgactcacgcattagcactagggctatcccgcggatagtcctgctacataatctcatgatcttaacatacgatggccatcagcatactgcgatcgtcgatactctcgttacacttaagggagcagctaggctgggggccaatccagctgcgagggttgcttatcctac

SEQ ID NO: 5074 - DNA, 531 bp, Bacillus thuringiensis
ccccacacgtggggtttaggcttccccagggttgaaaaggttggccgccaattcaagacggtttcccttttccccgttttttttaacccccaccttaatttaaaccacctcaaaaacaaccccccccggcgcaatggccctttgttattgtccctgggggaaaaaccacatttggaattctcccctggttaggtgcccttcctgatttgggttgggccccattgggaaaggaatttttggattaacctttttatttggaaaaaggagacccgttccttacttggggaattccggggtttttgcaattaaatttaaatttggaacccctttttttaaaattggcctgtttaaaagtggggggggacccattccttcaaaatccccaaaacttaagggcattttcttgggggaccaaaaaatttcctccctcattttttttaatttccccgagggttttggtaataggggacgggcaatcttatcccctcttttgggcttattttttcccacattttaggaaaaattggaagg

SEQ ID NO: 5075 - DNA, 421 bp, Bacillus thuringiensis
gtatgaagagacaggttacgcatgtggttcgcctggctatttctatgcgtagctcggactgttgtagaaggcaggcgtatcttgcgtgacgcccttaccgattgacgttcctaatggatggacatgctcaatagtaagcgatatttgtatgcgacaatataaggataatgatcggataatctggttgttacttgacccggtagtacaaatggtaagggaaagtccttaacatacctcatatacctacacatggctccgcgatgtaccagtgtgtatctgcagtccgctgctaggggaccctgattaagagtgttatcgccaagaatcagcggctaatgacgatctgtcacggggtggacctgcatcttaacccagatctttgaggagagtgtttggtgaaccagttgacgtgaactctgaa

SEQ ID NO: 5076 - DNA, 594 bp, Bacillus thuringiensis
gctcagaagcttgtcacaatctaaatctagctgtttatcattttttacccatgcccgaaactaattctcagggggtttcacaccaaggcgacgatatgcccatcaattatacgcttttttttcttctaaactaactcattcactattttgaattccacatataaatgcttcacaatgatttatattacaaagatattattaacgaacaaccattggctattttattatactaatccgtactatcaaagatgttggtatcctatgtttcttaatttcctcgatccaaaatgaactgaacaaatttattctggactaataaataaccttgatttacgagttttccccgataccaacacccatttaacactggtccttaaacgttgcgcccttgagccttgataatactgtagaaaaaatgccatcttacatttaaatatatatatcttcgtgccagcctcggtccaagtccttattagttcacacgggaaagctatattggaatatttttaatcatcacagccccccacctttttaggaataaaccttccatcaatataatctttttgccattgttcaagcttaatcaccggcgta

SEQ ID NO: 5077 - DNA, 227 bp, Bacillus thuringiensis
tacggatacttgtacaactgacttctttagaagcttgttaatttaggagagggatgcgttactcccacgtgtgtagtttaacttctacatattgtaaacgcttcatagatacagactgatcacagttctacacggagcgctagcaggccaaactatatgattgtctcctcctagcagcacgagatcgaccatgagatcggggaagaaggcctggaacgatcactctt

SEQ ID NO: 5078 - DNA, 143 bp, Bacillus thuringiensis
ataccggaagtgaagttttttaagtcccagctgcaaaataaacatatgggagcatggaaagcctaggacaacgcgcaattacacatggggaaacggaaaaaaggcaacatagtggcttcataaatggacgctgtcaatcgttt

SEQ ID NO: 5079 - DNA, 176 bp, Bacillus thuringiensis
aacgctctgtattctaatacagatatcgaaagtgaatttttttctgttccacgtgtaaaataagctaattgcgaatacgaagagtgacgaaatcgaaaaagttcttgtataataagcaacaacttaccaattagttatctattaattggccgcattgtttgtttttacatttgaca

SEQ ID NO: 5080 - DNA, 104 bp, Bacillus thuringiensis
gaaaagctatggaactttttttccaagaggttattcaaaccaaaaagttggctactatgggccttttggtgattccattggcttcaacgggggaagaatttagg

SEQ ID NO: 5081 - DNA, 173 bp, Bacillus thuringiensis
cgtacggtatcacttaaaatggatagggacttcaactgccttttaaatggcctatcatgagcctgttgacggggctcaatagagctcactagatgaacaatcactgattctaaaataaaaaaagcaacatataactaatgggataaagatcatcgttaagacagacataccag

SEQ ID NO: 5082 - DNA, 185 bp, Bacillus thuringiensis
ggcatctgatgtttttttgtttgctacaccgccattcatttttgggggactgtttttatacacgataccttctttctggttgtacgggtcattggccacttgccgcttgtaatccatattgctccaaccttcgcatatctgaatggtggggaagttctataggctcgactctaacttgggctacg

SEQ ID NO: 5083 - DNA, 227 bp, Bacillus thuringiensis
tccgcgaacagcgttgcggcaaaatgagtaattgcgggattttacaccgcaatctaagctattacaactagggcacaagaactagatacatcaccaggaattacaatatgggctgtgagtctatcatatgtactgatgcaaggaatgtctatacttatattcagaggcggcatacaggtcaataatgaagtagttatggcgtctgcaaatgcttactgtgccagatg

SEQ ID NO: 5084 - DNA, 122 bp, Bacillus thuringiensis
cctctcatttcagactattatcttaagattttaactcatcttttttaatgccaaacccaagactgacgtaggggctgcactaatattacttcgcggactctaacatgtcttaactgctaatc

SEQ ID NO: 5085 - DNA, 475 bp, Bacillus thuringiensis
gtcacactttactatcctgataccgcatgaaaactcactcgccgtgttgagatcatacaaggacacatcgggcatcatgaaggaaccattaacggccttgtattgctgataacacctgcagcttaccgttgcctttgagatttgagcgggatcacagagcctaaccataacatggattgcgatagtatcggcatgacaggaacctccgtgctcatgactgtgggtgaccaaacttatacactggcagcaataacggccgctaattagaggaccacagtattagtcgcccaagcgtgagcaccggcttttgaaccactttattggacaccacatatggtaccctgcgatgatatacaactggcacgaacaggcgtctaaagtagtttaccaatccatgttatattaacagtttcctgggacgacccttccacaggttcgggctgtgattctgtagcaaaaaagacgccttgtaatt

SEQ ID NO: 5086 - DNA, 160 bp, Bacillus thuringiensis
cataatttttattgggaccaccttggaaatttcagtcatcgaatcttgacagccccatagtgagcattgcattccactaaggcaacctgattagggagcatgggatcggagaggacaggaatacataatgtcgccacaatacagaatatgacttgccaat

SEQ ID NO: 5087 - DNA, 341 bp, Bacillus thuringiensis
atccagattgtagataccgttgaaaatgaggtgattaagcatgagatacttacagtacaaaaccgtacgctaatgcgtatccttggaccaactggtgcggtgatgacatattctttaaaccttctactggtacagatttcaccactctcacgtgaatatgcgtacaatggggatggataatacttatcatctttaaagcgatcatgaactctgctgaatgggtcggtcgcactaacttactaccatttatgaagaatagacgcaactggtaaaaggccaccatcttgatagctcattccatcaacaagacggctgtctccatatgatactgtaagaggaac

SEQ ID NO: 5088 - DNA, 291 bp, Bacillus thuringiensis
cagtagtagaacatgcgcgtagatagacaaaacctagtgcactgtcagcggaaccacggataatggctgaggctacacctgaccctacactggcgtatactccatattagccgactctacctcctaaagctagatcacgaaaaagcattggcgaatgcgactgcattactatatcaataccttactggtgtatcaggactgtaacaaatcgagtgaaacactatcgtaccgttgatacatgtatcgaaagtataatcgaactgtgacatatttctgagcgcccgcaaatgt

SEQ ID NO: 5089 - DNA, 318 bp, Bacillus thuringiensis
gtgcctctttatgcaactgagacaacatgaaatgcaattgaccgtgtagaaagcaatatggaacatgccgggcattatgagtgctcctttggcgacctggaaacatcgagagagcttgcagcttacccatgcctaagatatttgggtggtgtcacacacccgatccatataatggatggcgataatatgtgcttagcgggtattacagagccggtttccgtgggtgaccgtatgcatgcacttactgaggtaactgccgctttcgtgaggaccagagtattttgttgcccaaaggtgagcagctggctttagaaccac

SEQ ID NO: 5090 - DNA, 426 bp, Bacillus thuringiensis
cccacccgtggggttaaaacctgccctgggctcgaaagcttggcccccaattccaaatttaagggttgggcataaaaactttaaccccaaagggaaaaaggggtttggagttttttgaaaggaaattttttccttagggggccgggccgtggaaaatttccattagggaaattttggaggtttcccctccagttgtatttttaaatccgaatttggggggaaaatttatttctcatttggcaaagggaattgccaaaccagtttttgggttaactttttcggggtaaaatagttccccgggtttttttccggagattgagaaaaaccccccaaccgttttgtttaaggtggttttagggccagggcccccacccaaaccccattaaaaagttccggttagggctcttataaaaagcctgtttttcc

SEQ ID NO: 5091 - DNA, 125 bp, Bacillus thuringiensis
tagagtgtgagtctaaaagaggatcgtgttcttctcattttatttaatgcggcatactgcctctgtgtacgtgctcacacagacgcgccgatgggagcaattgatgcttaagataagtagggtcg

SEQ ID NO: 5092 - DNA, 213 bp, Bacillus thuringiensis
attacatcttcttggaattttcgaggcaagttcagggcactctagtggggtagtgtacaaatgccaatacaccagacacttgtacaagtttaccgcgcgacttaacggtttgattaacatgagaactaggttggatcctgtttttggaccgtagtgaaagaaaatctgactgtttacattgaattgtttaacccccttgtaaaaaaaaaacaa

SEQ ID NO: 5093 - DNA, 197 bp, Bacillus thuringiensis
ggactattaaaacttttcatgcagaaatagcacgtactacgtgatgtgaaagcgagtggaattaactactggataggaaattcatgcctaaactcgatgattacccgacctttgacgtgtttggtgatgtttctgtgatatgaactaaggcattacagctttttataaatatgcattggccatacgtaaactgctca

SEQ ID NO: 5094 - DNA, 127 bp, Bacillus thuringiensis
ctagcccgaccaatcttcttactgacaccaccgcccacctggattcaagggggtcgaagctcgctgcacacaactgtgattgaggaggaactccagctcagcggatgaaacgtggtgattccaacct

SEQ ID NO: 5095 - DNA, 219 bp, Bacillus thuringiensis
tgatggtattaagtacacccgccctgatgaggtgggagcagtggagtcatatataggataacactgatgagtggaagtagcgcgctcagcatacgtagttctgctaaggcacgggtgagaagtatcaataagtgtatcaaagcggtgtctttatgtatgcggcttaagactatccgacagggattatggtcatgctagctggctgaactggatatgcag

SEQ ID NO: 5096 - DNA, 188 bp, Bacillus thuringiensis
ttacaacattttgccattttctagggtcgcacagggcacctaggtgggggcgtttcataagcctggacatcgacactatacattttatcccgcgactggacggctgatgaacatgagactttgcaggatcctgctattcgagcttttcaaatagatccccgtttcactgaagtgattagccatgcaac

SEQ ID NO: 5097 - DNA, 181 bp, Bacillus thuringiensis
tggcgccagtcatataggcatacgctagcttagaggggtattttgtgcctggatctcaaaaactactggtcttgccacttcccgcaatgctgcttctgactaacctgctaatattactgtcctttcttctaggtgctttcgaacatgattaaacacccctgccaggtcaagctctttcatt

SEQ ID NO: 5098 - DNA, 196 bp, Bacillus thuringiensis
gccaaggtgatcaatttgatgtttctacaaaccttatgatataggtgcgaaagcaccatcaacagatactttcgctcccaagctgcctcccattaacgaaagaactggttatttgcgtgacagacctacgcacgctgtatctggagaacgataaccctatcaccgcttcttacacgtacaggagatcccgggtata

SEQ ID NO: 5099 - DNA, 266 bp, Bacillus thuringiensis
atcttgcgctactgctccaacttaccttcaactggcaagaccactttgtgagcacatttgaatgcacaacgtctcggcttttggataacggagttatcaagccaactagtatttcctcatttaaaaactatgataagatggaataatctcacgcacttacttgataacacaattaagtgcagccccataaactgcacacaaatgctctcggccacgtaaatgcaacacgcataagcacagtttacttcattataccattcctgaat

SEQ ID NO: 5100 - DNA, 168 bp, Bacillus thuringiensis
tgacttgagcctgttttttaattaggcccttttatttatccaaaccggggtacttacggtctcctaaacagaaattttttaatgctgcttcccggctagaaaactagataccatcaatccattaaaataagcacttaaacgctgtattcaggaaaatctcttaaccct

SEQ ID NO: 5101 - DNA, 254 bp, Bacillus thuringiensis
catcactaatgatgaagatgtaaagcctgctatagaatttttattagagcggagcccgatcacattaggggttgcttgtacactcgcaaagacgatcaaaacacaaggtaattcaattattgttgagggattatgatgctattgatggcagtttatttcatattttaggtagaaaaagcatcacgtatgcctgcacaaataattattttccccctgatgtatttattataaaaattattttaaggttttatttt

SEQ ID NO: 5102 - DNA, 150 bp, Bacillus thuringiensis
gataatctcatgattattaaagcggtctgttcacacttacaggggcaccgggggtgaattcagccatgaaaaccggccaacgttctggttcatgccgtcttaaaattaccataatgcccgctcgctaattcatgaactaatctagtgtcc

SEQ ID NO: 5103 - DNA, 108 bp, Bacillus thuringiensis
atctgcggaaaaagagagtgctattactgtataaccaattttttcaatcgctgaacttagtgcgtattatggttacgttcggggcctacccaggccactacggggtgc

SEQ ID NO: 5104 - DNA, 134 bp, Bacillus thuringiensis
catacacatatatctaggtactgatttagcatatactgaagctgcagttgatggatgtgcagattatgaataccgtattattgatgacatcggatatggaacgagggatgcaactctccaaggcagttccatag

SEQ ID NO: 5105 - DNA, 204 bp, Bacillus thuringiensis
catcgaattgctgggatccttttaccaaagcgcgttatgctagcagtgacgcagggatcgcgtgacttgtcccgtattagtggagtccgtctaatgagcattggcttacatgaacaggaatatgctgcgttctaagaaggagcggaagctcatcatattaccacacatcatactaacctgcagccttaagtgtctagcctgggg

SEQ ID NO: 5106 - DNA, 210 bp, Bacillus thuringiensis
attgttattcgcgaactactgacttgcatgttccgaatactttacatactgtactaaagtaagcaggacaagggagaggttgttatgctaccgccacgcgatgcggttgtcacgaactatagtttgatttaaaacgcttcattgcaacacactatttggttagctttttgaccaccaattaatgcagctacatacttagtgctactgctt

SEQ ID NO: 5107 - DNA, 460 bp, Bacillus thuringiensis
gatgcttagtgggacgacattggtatgtctaaacggagaaaagtgctacttctgtaactggcgatgcatgcatctttgactttactaattgggcgctagggatatgaaaggacacggttccttaatataccacagtatagactatggctgagtagacagtgtttgttggagaatgcccgtctgtctaatcaaaccgtgttacttatttgccaaccagcatggccgcgactcattatgctctccagatattcgacactctcatatcctgggacgagagactcgcgcaggcaggtgcaaacaaatacgagggtcagtgcattcttaacaacaatgcactttagtgatttaaagcactgtcgacaacctaaggtgatgatacgataacgtgcaagatgagtttacttgagcgtgcaagcacgtgcacatcacggattatcttacttacagaacttgatgaaat

SEQ ID NO: 5108 - DNA, 176 bp, Bacillus thuringiensis
aataaataagaccagctgctcttggaccaagcacacatttgatcgctgctgcagtaatttctatagcacgaaattgccaagaaacgaatagagacgagtgataacatacaggtagaggatcatgtagtgagccgtcggcatcaaaattgttggacgggcatttgctctacttacgg

SEQ ID NO: 5109 - DNA, 324 bp, Bacillus thuringiensis
aatggaccctctgggttagaaagcactgcacgaattacatgcaaataatactgcataactacaccaaacactggaggtcggaacaaccttaatacttccgtgaaataattaacactcagttcataagagtaagcgtgctttcccttaatgacccgccgaaccacaaaagacatatgtcggtaaaaatcgttgcaagctcattgataaagagatggttcgtttcaagaacttttacgtataactcagttctatgatgcatcggttccaaaagacatatgtctcgactgcaaggtggcatcgaaaatagtaccaaccattactttt

SEQ ID NO: 5110 - DNA, 158 bp, Bacillus thuringiensis
  unsure (1)...(158): unsure at all n locations
naataccaataggagtttcattttctattatctatacgggcaccaccacattttttttctaaaataaatccatcgggaacagaggttgtccaactacctccttcaattatgatctacaaaaaagatattgaattggaattcctttaaataacggatct

SEQ ID NO: 5111 - DNA, 461 bp, Bacillus thuringiensis
cccccggggggttaaagcctccccagggctcaaaacgcttgccaacaaattcaaatggtttccccgaaaatttccaaaaaacccccgaaaaatttcactaccttccccggggtcccccataacctttataataaaaaaatccacaatcctttttcttggaattaagaggcaaccttaagccgttgggcccctaacttaaatatagggcctttggggaacctccccggctttaaacatttcttaattttaaggttcttcccaaaaatttaaaataggggggggattcctttttctatgggctccactaatggggctacaacctctggaaagaaaaacctattccccccccttattataaacggtttttttcccaaggcctatttttatgccggaaacccccagccataaaaattttttcccggggcccgttccttaaaattctccaaaaaccaatttccccc

SEQ ID NO: 5112 - DNA, 187 bp, Bacillus thuringiensis
attgatcgaattggattctgctcacgctcttcaaaacctgattaagggggcgaaacatgaccgacctcaacttacaccatgatttggttatctagcgtaccaagctccagttatttctgcatgatacgtacgatataaatcaaggaaaagccaaaactcattcagtaatctcaattcctgtggcaac

SEQ ID NO: 5113 - DNA, 281 bp, Bacillus thuringiensis
tgcttcctcatacgacatacattttctatgaagaaacttctttgcgaaataggcgggatcgtcaaacacacttatgacgctccgcacgaatatcgctggtgtatcataaaacttctgtgcccatatgaaacggattcgaattgtacacaacctctatcatctgttctgtgtacccaatgcttccgctataactccaaatacttggttgtcctatcactacctatttctagaagagagaactttataactaattggttctacataaggagggagcatactta

SEQ ID NO: 5114 - DNA, 169 bp, Bacillus thuringiensis
ggaaagtactagtttttttaaggccagccaacggcctgtaaccggggagtggccgcggcgctggtgctattccatatgctccgtccacatgacaagtatcactaaaaaagaccctcctgtcagagggggtgtaatatctacaggaaaattaagtaatcaggcgtattac

SEQ ID NO: 5115 - DNA, 223 bp, Bacillus thuringiensis
cggtccaataggggcacgcattaacattggaacaccggaggttacggtgatagatccatgtttctgccacatatcatgcgttgtatgaagacttagcacaaagctagatttcgtgcctgcggatgctttagagacatgctctactctctgagagattggagacttaagttgtggaaacacaattctgatggccacgcgaactaggacaactactccatgatcg

SEQ ID NO: 5116 - DNA, 195 bp, Bacillus thuringiensis
accaccggtatattggagatagctccctatgcgctcatttgtgggagtcagttatttgccacaggactacgtgcatctactgcaccgtttacagagataccaccgtgctatcgagctgcgccgttaataaagtgatgaatacttactgtttttgctacgcctgagcgcaccgtatgggccaatactgacctgcgt

SEQ ID NO: 5117 - DNA, 247 bp, Bacillus thuringiensis
gcattcataacggggattttgacgtcaagcgcggtgcgcgcttgacggctgatgagtaaaaaccggtactctatgattcgcttatgaagtggctgcgataagctagaaagaactactatcataagatcggaatgaaagaattgttaataactccacaccatacatgcgaacaattgtttgtcttggcctaagaggggacccgaaagggctttaagactgatatgatttaaccaaaaaaacgtgggtt

SEQ ID NO: 5118 - DNA, 414 bp, Bacillus thuringiensis
tgacgaatatcacttttctgacatgtgctgaactgatggacagccctcgccatgagaaccgaccgttgcaccacttgaatatgataaagtagaatgtcgtcgtgaaaaacttgatttataggcagaggttccgctgcgtgaatataaaccatactggaggcgtgttgatgcgacagaacacagttttgggcctcatgttgaacctggaatgcaaaaaggtgtagatcatgttacatgtggttaatcatgaacagactggtatttccttcgggtgtgtggcttatcgtctagcagaactagctggacactctgcttccggctgaaggagatctttgaattataatgacggcgggccatcaaaaagtacagcttgaacacacagacgctttgcaagctggatttaactggccttgc

SEQ ID NO: 5119 - DNA, 131 bp, Bacillus thuringiensis
cgagactaatttatgatatctctcgtcggtagaagctgttctaatacctagccgtaattagtcatttaggcttgttcgcggagtatacaacatgcgaaccacagggatgctggttaactaatgaggctgtg

SEQ ID NO: 5120 - DNA, 122 bp, Bacillus thuringiensis
gatcctttgattctcgttttttcttaagcgaccatcttgtttggagtgcacgcggatttgatgcatgcatccatgggttggacaccattagtaaaccatactgaacaccatcatgcaaatac

SEQ ID NO: 5121 - DNA, 308 bp, Bacillus thuringiensis
cacaaacacatatccgaattaaaacaattttttcatcaggcgtcccgttctgaacatgcgcggaggtagcctaacctttaggagcttgcgaaaatagctcatgagcggaaaccgctcttgagaaccatgacgtcccttacctaagtgcgatgctgtcatcgctgacgatttcttctggttgtatacgatggacaatcctatttatactttctaaactctgttctaagcaaagcgcgcatttatcaaaactctccggcatcgcgtgtacatttgttataagacgtgaatcatttcttaacgaaccgctt

SEQ ID NO: 5122 - DNA, 306 bp, Bacillus thuringiensis
ggacgtatgacagcctctatcgcttagggatttctgttacgaacatgcgcgtatggactcggtacctttgaagcgttgaaaatccgtcctggggaaggaacgattgatggtttatgtatgctttttacactaggcgctaagcgaggtattggtgtgttacttttgaccaggatccattaacaaattaagcctacacaggcttgtttattgatctgtagagcgcctctagcgcatatgatacaatgaaaaccgtcaactgatgtgttgagcgacatgcaatggatgctgaactataaagtgcttatt

SEQ ID NO: 5123 - DNA, 233 bp, Bacillus thuringiensis
ggcatggcccaggtggcatttgccactacatgcttccactacgggacatagacgttacgggagcgtccccatgaacggatctgtgaactgagttatagagcgggatgtggggtctgtaccgacgtttagcagaacgaatcccgctttaatactgtataatacaccgtccgcccgaattacctgtgttgtacgaagacgcgcgtgcgctcttcgttttcggcggaaatgacatg

SEQ ID NO: 5124 - DNA, 142 bp, Bacillus thuringiensis
cgatccggcacaagcgttcttgctcccgaacatacaccatatttctttctatctctcgaccattaaaggggttcctgccatacgagcgtgcacgggcttgtccgtagaatagtacatatccactcatctgcatgccctttca

SEQ ID NO: 5125 - DNA, 377 bp, Bacillus thuringiensis
aaaatgggctggggaagggggtttttttacttaaaaggggggaaaacgggtattccaaaaattggggggttcccccgggaaaaaacttgggaccaaagggccagaaaaggcccggaaccttaaaaagggccgagtggggggctttttaccttgggtccggccccctggccggctttaaaaaaattcgcccctcattaaagggggggaaacccccgccgggattataaaaaaccggggctttcccccagggaagctcccttggggcccttttttgtcccaccctttgcctttcccggaatcctggcccctttttcccctttcggaaaggggggccttttttattaccacccccggggggtttcccatttggggggggg

SEQ ID NO: 5126 - DNA, 233 bp, Bacillus thuringiensis
agatcctgccatagttttcttacacccgaacgcacaatttttttcttgttatggttcaaagattaatggggtgccatctctaggagctcaaacgggcactctcactgatgattacatactcaaccgtactcggacctgcacaagtgcgaaaatacactcattctcatgaagagcctgagccttcacttaacataaacattacacagagttctcggtaaacagacgcggcacaa

SEQ ID NO: 5127 - DNA, 163 bp, Bacillus thuringiensis
ctgtgagcggcgacatctaattctgacgagagggacattttttcccctgccctctctctatgttgacctgcggaatcagcagagccatccacgggatattaacaatcatcactgatatcactgatagaacctttaaccgttggccatggcatggcggaatgtc

SEQ ID NO: 5128 - DNA, 211 bp, Bacillus thuringiensis
cctaaggcgacagatttttttatctgcctagacgtaaacgcgtgatcgcgctcagaacaaagctcatacgtagccacgccggattcaacgttatcctgcgttatgcggcgtctccagacgtgaaggcgttacagattccacgggaatttttacttttggtgggacgtatataattcctacctaactacatgggaatggaaacaaaaaacgt

SEQ ID NO: 5129 - DNA, 209 bp, Bacillus thuringiensis
aagtagtaaaacttgctgtctttgaagacaatgcatcaagatgctaagggggtggagctccaataaacgcctacgctaaggggggaggtgaaagaaatgaaagcatcgccgcttatggagagaatgcaatttcaaaccacaccattcccaattgttgggcaagaccaccgttaaaggtagaatagtgtgctcacgatactgctctttac

SEQ ID NO: 5130 - DNA, 246 bp, Bacillus thuringiensis
actgcaacagctagcattggaccgtgtgacgcctctttttcttcaccttgataatactgaatacccacttgattcttagctcctcataacttaccctgagcttgttcccacgctacagcaggcggatcatttctgtacgcatctgatgggtccgcgatggatacacagaatgagtaggcttcataaagcgaatctctgtacactgatcgagctaagcttacacctcggccaaacactactttttta

SEQ ID NO: 5131 - DNA, 487 bp, Bacillus thuringiensis
ttgctatctccacttgagtttgtgcttgtctttttatctccgcctgatgtagaacatgctgttagtgccatgctcattgccaaaaccggtactacaactgctgttagttttttcatttttttctttttcattttctgtaccctccctaattctaaacgatagctattaaagaattttctgataattctgtttttctctatatatttatcagacgattcttactaattcttattctactaattttttaatttttgtaaagtattattattgaaaatttttaaaaaattatttttttacagtaatattcataaaaattccatatgttgttcaaaccttattttgcattcatacacattcgttgttttaatcacttcgatctcatttaccgcttgaatactggttaattattgctaataaataatgcatatatgtaaaaacatcttttctacaaaataaaaaagcagacatttcgtctgctttaattctc

SEQ ID NO: 5132 - DNA, 190 bp, Bacillus thuringiensis
tacctatatactgcgtttttttatcacgaaatcagatgacttacaaggggtacaacggtcatcgaatatttaggctgatgaaacaggagtgacaatataaacatattgcctacaagtagtcaatgtcaataatcagaacacttatgtgataatatggcatacggacgtatatcttgcgcaaaaacatgga

SEQ ID NO: 5133 - DNA, 310 bp, Bacillus thuringiensis
gcaatatagcggtttagactgggacgtataccatcatgattcagatggtacgacaaactttattgacatgtcaccagcggtcttccaccgatcggctatacctgaataatgggattctaggtcgcatttcgaatacgtgcgttccttcacagatgttagatgcagcgatgcaagtgaatgaaacattctatggtattgatcattggaatcaccgattacttctgcacggtctcaccagggcattatatcacaattatacgtaccggcacttacaatataactcccatacgtactatgctttataagcaca

SEQ ID NO: 5134 - DNA, 161 bp, Bacillus thuringiensis
tgaccctgataaggcacgttttgtctgacgtgttacgagcccacgaactgatgggccgaatttaattcgctgtctaggcggaagtgcatcgaaataagtgctacgggcaagtgacttacaacgtccttcatagatgacatatgatcatgttcatccatgag

SEQ ID NO: 5135 - DNA, 323 bp, Bacillus thuringiensis
atgcctgtattacgctcttctttataaaccatatctgctgtctgtcaccataggtagatattgttcccgccatattgcttactccttatcatttacatggaatctagactacgggttttactgatcggcctaacagccattaatgccggttcgtctgttgcgtccatataaactggaatatagatgtgcgacagctaaatcaacatgctcaccttattgacggatttcgtgaagtgctacattgtgctcggttaaaacagagtttaacgactccattgtgtttatcgagcaaccaacttcaggtgtacggttagggatgcccc

SEQ ID NO: 5136 - DNA, 274 bp, Bacillus thuringiensis
cacgtgtggtctgagcagcactccgctcctcagcagcttgccgacgactacatatgatggcggcgggtgttgtgaagaagcaacatgatgtcgtcagagatgtttaatcatcagtagaaggggggatgagttatcatgctgctgcggcattatttattataacaggcggcgaggctcctcagtattacgcagagattatggcgtcatggagcgcctttttatcgtgtgagattaaagaatgcgcaaaaagagcacagccccattatttttagaa

SEQ ID NO: 5137 - DNA, 142 bp, Bacillus thuringiensis
aattctaaacgcatgtgtatcctgcgtgggtccgtgctttatctagaatgagcagacacagatctgggcttaatctgggacgtgcgtgctaattgtctgaattagaggtccgctgacaacaccacaggacttctgattcgga

SEQ ID NO: 5138 - DNA, 102 bp, Bacillus thuringiensis
ctatgttgtacagacgctttttttctgaatactaagcttatgtttgatgaatgtggtgaatatcaatcaaaagaagccgtcctacaggactgaagctccata

SEQ ID NO: 5139 - DNA, 171 bp, Bacillus thuringiensis
cgtgatttatagacactacactgcttattactataaacggcgttttattgaaataacgcttatacccattcacgggggcatacttgcaaggatcccgttttaactaactcttaattctattttattactcagaacacctcccgatataaaacatcctgaatggagaccaat

SEQ ID NO: 5140 - DNA, 357 bp, Bacillus thuringiensis
ccaaatttcccagtgggttaaattttttggggggcggattcttcactggcaaaggcgagtgcttttatggtgtccccggggggaccgaggggttttgagcccgaattgaaagtatccgtttttttgtaagacccctttgggggttgtgatgggcctgggccaaagccatttaattttaacaaatggttgggatatcaaaatgggggaaaaccaacccttgttgaaaaaggggggcatgcattaccctgaccaaaaaaggaaggtggctccaataaaccatcagggccccgggggcttcccaaatgtcgcgcaaaaagatagcaaaagaccccgaaaagctggtgctttcttaagtag

SEQ ID NO: 5141 - DNA, 108 bp, Bacillus thuringiensis
cccgtaataaccttgtatacctttattcgcaatgtatatgtccacaaaaccatgcacaccttccgggggggcgatcaaaaaaaaccctgcaacacctacaataatggc

SEQ ID NO: 5142 - DNA, 186 bp, Bacillus thuringiensis
gattcacctggtggcggagtcatcctaatgctcggaggacataccactgcggaggggcctgttgtcttagagggacccgacgtaaccctgtgcacatatcgctataccacccaatatcatcaaccactgacacaaacggattcagacttctaaagtctgagtcctcttttaatttgaaaaagaaaa

SEQ ID NO: 5143 - DNA, 248 bp, Bacillus thuringiensis
cgggatcatcttgtccttgctgggactgtaccaagttttttcatggtctcatatactacaaaaaaagagggcgacctggctaatgagttcgtctcacaagacggcgaatcacatatgaagcgctgcgaaaacgatcgagagacacgtgatcatgatcgtgctgaagactcccgctttgctctagtcgcaccttggagaggtgcccactaacttgcgagtatcgcgacagtcaagccttcttgccggtg

SEQ ID NO: 5144 - DNA, 234 bp, Bacillus thuringiensis
tgttatgcccactagagatttgtcaaatgacggtagactgatttgaaccactgcgtaatgaagcacgaaaaggtctgtggaactttctttgtccgcatgagtctatgatgaaagaaattgagatgacgggtacggaaagcgaacccctattatattcaaagctagagccactcgtgaagacattgatacaaccgcattttatgggaagaaggggacaattttagccttttttaa

SEQ ID NO: 5145 - DNA, 107 bp, Bacillus thuringiensis
acacggtgtctagagctgcctagtctcaaacttttgtcaacaatattaaattctacctcccaaatggtttttgtcaagttaacgtttcacgctcgaaatgggcatac

SEQ ID NO: 5146 - DNA, 126 bp, Bacillus thuringiensis
tccttcgaaggaaacagcttccgcgctacctacgactgaacacgctaccaaaaacacgtaagaaatcccaaaagtaactgaaaacctaagaaacaacagtagaacccgccagcaaaacaaagagaa

SEQ ID NO: 5147 - DNA, 317 bp, Bacillus thuringiensis
tgaaaggatacatctgctagagccaatgaagataaacatgaagtatgtgaagtttgttaaatagatggaacatatgatcattaagctacggatagtattccggaaaatggaaactcttccaaatatgatgatatggaatgtgtgtgtaactggacgttgctcacacaaagggaatagacctgcgaataatcgatctgtgagggaacagacacccagtgtacaacgttatatatgtcctggataaggtccatatgcaagaatcatcatcaagaccatttatagtttcgatggctataaaggcagccgagatgcaaaga

SEQ ID NO: 5148 - DNA, 330 bp, Bacillus thuringiensis
aaacctgttctgggctcaaaagcctggcccccaatttcagatacgtaaatattgacttttttttagaatctttttttttatctgacaaacctgggtgggccattccccaaggctaaatcaggggggcccctttctcaaagatctgcatattgccttaatcaatggttgccagactcccggcgggggctttacctaccccccggggggttttcccttttgcccccggggttgcaagaattccttaagaccggggctcacggggtaaaatttttttcaggttattccagccaccgggaggggccaaccgcataaaggggccagcatctttcc

SEQ ID NO: 5149 - DNA, 415 bp, Bacillus thuringiensis
  unsure (1)...(415): unsure at all n locations
tgattgcaggtagtcaaaccaaatgtgtcaggtggagtaatatcaattagcnagatggcttcgagtagaagtaacagtgcggtttatgggacattatctgtagngagcaaatcataatggcatggttggagtaatatcaagttatgcagatcggattctggtcagagtaacaancagggcttaggtacctctaaatggtgagcctaaatcagaatgtcaaatggnctcaancccagcttaatcgacgtgcgtaaataatactagcagatggctcaggtaaaagtaacatgatggtctncgtaaaagtacaacgacggttcaggtgaaccttgcagtagataacttggctgaaggggcacgagaaaacctggggaatgtaaaatggaatcggataataacgtaatgatattgtttg

SEQ ID NO: 5150 - DNA, 173 bp, Bacillus thuringiensis
agacggccccggcacccagcaatacgtggaacccaacggttaccatatagcgaaaccacgacgagagacccctacgaagaaatcaggttgcaaccaggcggccaacacaaggggccgccagggcgaccacggagaagcgaaaagaaacgcagacgcaacaaacgccgaccaca

SEQ ID NO: 5151 - DNA, 170 bp, Bacillus thuringiensis
tgtgagatggggcattatttaatcaaacaaccatcactggcggacattggttgaccaactgccatataaacagaacgagaataaccgtaagctgtgaatcatcctgcgcagttttggcaaccaccgaatcaagaatggctaccactacagtcgctcttgacagacgaaca

SEQ ID NO: 5152 - DNA, 291 bp, Bacillus thuringiensis
  unsure (1)...(291): unsure at all n locations
aaacggatnntttttacatgnactcgattatacgaaagcaatagtattcgtacaagatggtacagnactatatnccacctggctagtattttcattcattttttgattcaccttatttggtgatggcatgaaaataaaattaagagatattatgaaccttcattggttcaaagttaccctttccttttcataattatgtacttcttaattgtattgcgcataccaaaaggggtttggtcaaaaacttattttcttgttcgcctaattttttgaatggtattcattattaca

SEQ ID NO: 5153 - DNA, 324 bp, Bacillus thuringiensis
tgatcatacttaatctcagtatcttaccttcaacttggaatataaccactaataatgacctcctttccctttacccttaatgtttgcagtttgatatcacagttatcgtattaacctttttttaggggcctttaggaggagagtccacattaagtatggcaaccttcttacgttttaatatatcacacttttacaacatccaacttaccgattgctaatatatagccatattcactttccgattatagccttatgagagtgatgatgcacagcctggctgaatactggtggattatttttcaggttttccttggaacttttctc

SEQ ID NO: 5154 - DNA, 126 bp, Bacillus thuringiensis
catcaaccagaccctaagttaggatcccattctattacagagttttgcagcctaaacttcatcaggagtggaagaagggggttactgcgacacttaatgcgggcgaagatggattttcctccaggg

SEQ ID NO: 5155 - DNA, 253 bp, Bacillus thuringiensis
ggcgtaatacatttttggggcgatttaagggggggtgaagaactctacaataaaaatacggtgaattgtggtcagtccaatttttattagcatatcgtagttgtggaaccctttgtggaaaggatgcctggagcccggaaatcatatggaggatgctatagcgctatgtgtgtattcgtatttaagccttgaataaaatcgccatgaagaaattcttatgggctgaggtgcaattcatatccgctctggtcat

SEQ ID NO: 5156 - DNA, 149 bp, Bacillus thuringiensis
aagtgcatgtaggaggtctttctttgcatgtacagtacaagaaagcctaagggggtgttctatagagcgtacaggcgttcaaaacattgtattgacacctaggcaggaagtcagttgattcccctcaggaagggtgaaacgcattgaaa

SEQ ID NO: 5157 - DNA, 244 bp, Bacillus thuringiensis
gttgataccgaatggtttctttggtcggggagcgttctcacgacaggcaacgcccaccgtaaggactggtggactgcttacaaatgagaacgccggactgagcagcgcaagacggctgagaatcccgtccacctaatgcctaaggattcctggggaaggctgagcacgctcagggatcgtcaggaccttagcacgggccgacaggcctatgcaatggacaacatgaagatattgctgtaccacc

SEQ ID NO: 5158 - DNA, 222 bp, Bacillus thuringiensis
caagccatggcgtttttcgattttcactatactcaaattcctatgtgacggcatcggttatcattgctaaaggctgaatcggttttaaatcatcatgtggagcaacagttttcaatatcagcgagcttgagcacatggagatatgctttgtatgcatctaagaacaggattgtttataatcccaattttcttagtctgtgcaaagcacatcaattcttacct

SEQ ID NO: 5159 - DNA, 206 bp, Bacillus thuringiensis
tgccgtctcggattcagtaggacccgaacttcgggaccacgtgagcacttgcgagctgcaccgacgcatgtttttattcgtaccaaaggaatggaccgaaccggtgcgctctgtcaacatggaatagaccgtgttcggaattatcagggtgatcacagtagtttagcctatgctatcattaccttaacgacgcgatgagatatcca

SEQ ID NO: 5160 - DNA, 261 bp, Bacillus thuringiensis
cgccctttgacgttgcacatccagcgcgggagtaacgcactacggatccaacaggggaacgaatctgaaccctaggtgggacagtccataaggcggaaaagggtaggccacgcgcaaccatccacagacagaaagaccggaacgctggacaaaaatggaacccgcagacttaccatgttaccatgaaaggcgatcctaagatgaacgcaaccaagtgcagacaaaagcgaggaggggaacccagacatgcctccccaaata

SEQ ID NO: 5161 - DNA, 202 bp, Bacillus thuringiensis
tttacgaatggtatcagagaacgcggggggttttaaggacaatgaagtctgacttcattagaaaagaggaattcttagaattgaaaatgtccgggtgactagctgaagaacgttgagaatcccgcccaccgaatgtctactgtttcctgatgaacgatcgtccgctcaaggttagttatgacctaagaacgagggcgacagg

SEQ ID NO: 5162 - DNA, 159 bp, Bacillus thuringiensis
gttaaaattcgcgttttttttttgttcgaaacgttcctcccaaaacgctggggccaaagcaggcaatgttgctcgaaaacctcaagagtcgaggggcactgacagcagtgctgccagggactcaacttcaagttcatcgtcctagaggaggcctgccat

SEQ ID NO: 5163 - DNA, 275 bp, Bacillus thuringiensis
ctcttaatacattgtctgggccgaatgtatacgtttcatgaatttgcgagacaattgcggtcataaaaccggaacattgggatatggcggactgttctttaacgtagagataaccctgattccaactgctacaagactcgtccgccgaatgtaaaagcattctggaacctcaagcacattctcacaatccgagaacacttagcatgatgaagcagaagacaccacaccctagtttgcaggacaagcctcgtcaggactcgtaattgaccatgaca

SEQ ID NO: 5164 - DNA, 210 bp, Bacillus thuringiensis
gagactggccactgagatcccatggttcaatataaaggcttataatgattcccatccatttgggacaccattgttcaggtcaactggatgcatggaatctcgctctacgtgcattataacacctacgcgagagtccatgtatcatcctgaacgtcatccgctaaattggcccgttccacctgtaatgaaatggggagtgtttctaacacc

SEQ ID NO: 5165 - DNA, 364 bp, Bacillus thuringiensis
ctgacccactagctctttaatgaacaaattctacgtcttatatgacgaccatgatatttggacctagaatatccgctgaaagtgtggaccggcactatctatattacgaacccttgagcgtctatgtgctctctcatctcgttacgtatacgcattacagtttcctgggcatatgtaggcttgcccatccactgagtgaatcttcctccttagatagctattccgccactagaagaaaccgcatgggcttcatcaccttgtttatgctaattcccactttgcgatagataaaagacctgcattaccgaagtgcactctaactgttggacacgtgtcccacagtcggcggagccaccattatgga

SEQ ID NO: 5166 - DNA, 196 bp, Bacillus thuringiensis
aaatcaacggttcatatataaagtgaaggctggctatccctttttacaagtgatggtactacggatgagtctgggggccatatgtacctcatattgggggattgcacccactcatctatggatgctatcgtttatacatttagctcgtgtaaatgcatctttcgtttttcaccacgagcgggcatttattcccctt

SEQ ID NO: 5167 - DNA, 103 bp, Bacillus thuringiensis
gatggggttctaacatttgaccgacatcctctagtgagaaacaggagcggtcatgctcctatttcctattcgaacgacttcagtgatagtgcgattcaggaca

SEQ ID NO: 5168 - DNA, 204 bp, Bacillus thuringiensis
cccgggggggcataggccccccccggggccgaaaaggtgggcccccaattcaaaatcccgaaacggggttttttaaaaaatggggcccggggccctaaaaggggcggggtttttcccccccccggagggccctttaaaaaaaaaaggccggcagggttttcccccccccttccaccattgggaaaatttttaccgggggaaccc

SEQ ID NO: 5169 - DNA, 233 bp, Bacillus thuringiensis
gctttgtgatcttggctctttctttacagttccactgtctcttcctcctcttccctcactggccactcttggttcacactctttaattggcgcatgagcgaatcaccctatcgatcccctattgtcagcggttctttcttctggtgattcacctggcattggctttgaacttggctttgcatgttttgcttaatgcggctcagctcttactttctgcttcattagtggagatg

SEQ ID NO: 5170 - DNA, 148 bp, Bacillus thuringiensis
acagatgcaatggacactaacgctttgactatttccggtgtttaagatgcaccaattcaaattactggaccttcgagggattaaggaccagcagcattaactggcattaatgaaagcatactaaactgcgtccaataaacaaattcct

SEQ ID NO: 5171 - DNA, 199 bp, Bacillus thuringiensis
taacaacgagtgtgacaacggtacttggtgttttctttgcattcgcttcacatcgacagaaatagcgcaaaggaggggctactcttggccgttgttattcacaacccatgatgcatctgtgaaaaggggattatctatgcctgtgaaattgatccagttaggaatggaacctcgcacaaccacgagtattattgcacat

SEQ ID NO: 5172 - DNA, 341 bp, Bacillus thuringiensis
cgcatgctgcgacgcatcctgtctcggatacaaacttcgtgatctattgacatgcaaaagatgcgtacttacaattaacgttcttttgtggcaagctacatgtccattctagaagcggctggagatagaactgaattacttgcacctgacaaataatactacattctacaatcgcccgatttatcaaacaaaaaggtataaggtgatcatcaccttgcgtatcgtgaccatgatttagatgtggctctggaagagttaacagatctaggccttcagacattagaacattcactacccattgataacctgcagtcttaaggttaatcttatgttagacccac

SEQ ID NO: 5173 - DNA, 202 bp, Bacillus thuringiensis
agctttcaccatgctttcatagggagtatttatattagtctatggtgcctgcgtctagaggttcatttaaacttgcaaatgcaaagatatagcccgtgaaaaacttaataaaagcatcctctacatgtagaaaaaccagccaccacgctacatggattgagaaacctgcctatagcgcgcgtaaagggacgggaatgaactg

SEQ ID NO: 5174 - DNA, 180 bp, Bacillus thuringiensis
ctctgaactttgaagtttttctacaagccgaatatgcgtgatgcaagggggcgccacatattgcaacactggaaatcaaccacgcgtatgtaactgaaccgaatatacgctagtatcagcatcgaacgctttcaaaataatggccaactccactttaacacgctataaatgtataggggg

SEQ ID NO: 5175 - DNA, 223 bp, Bacillus thuringiensis
gtgctggatgatgtacttctatccatggccttatctacacaagctgatccggttgcatataaagagtatcgagttacatcatgtcgtgttgaaaccggaacgaaaagtttcggcttatacttaggaacctctgttgaatcgcaaattgcaggggttaatgccgctgaatctatctgcttggacgatatcttactaacgcggacacaacactagtggagagggc

SEQ ID NO: 5176 - DNA, 332 bp, Bacillus thuringiensis
ctgtgaaaaaaactaaacttgctcaacagtttgttttattgaccatatcattcttagagaaaaaagagaggggtattcggcaccaacaacactacttacgacagcacctggtctacggtgtcattcgatacttaagtgcgctactccaggcaagcctaaccgcccgcgatgattaattgatggaactagcaagtgacgcacaggtaatgcatggagcactaggctcaccagcgaatgaaatcctgattaagagtaagctccgattcgtaagattgacttgtgtaatccgatcgacggtcgcatctatcagagtgctaatacaagcaaccgga

SEQ ID NO: 5177 - DNA, 100 bp, Bacillus thuringiensis
atcaaatactggcttctagcgcccgcaaaggcagcatggcacgtgtctggctctgcggtgaatgcgttgaatcaaaacgagcatatacgaaagtcataga

SEQ ID NO: 5178 - DNA, 259 bp, Bacillus thuringiensis
ggcacgacatttcgtacagagtgttcgttgaaataaatgatttaattcacctttgcatgctcaggatcttggtggaggttttttagctctaaggactttttcaacatttgcaatcgatactcttgatactgaacgtactctcaaggtatgtctacagctccaatcacaagaatgatcgataacagccgccattttataggaaaactatgctctataaatcatagataccgccggttgttgagacctttaggattacgca

SEQ ID NO: 5179 - DNA, 111 bp, Bacillus thuringiensis
tgacacatacctattttttttacagagacagcaagggttgatttatgatttgtaactcagggtacgttgtcttgatagctctcccggacgatagatgcgctattacagggg

SEQ ID NO: 5180 - DNA, 301 bp, Bacillus thuringiensis
cttaagatggcatttttttttacacatccctcaggtcttgacgagcgcctgcaaaagtaccacctggaccagcacgtgcaatatacgcatgttggtgcccacccacatgatccctgaatatctcgccctgcagtttaacagtgaagtcaagtatgcaattgagcatgaaacggcggccgcatacacaaccaatgatgtgatgctaattgactcgctttgacgaagagcaacatcgatcgctcattgccgcggagtcaatactacatactgtccctaagcacgaacaagatgacgacgctca

SEQ ID NO: 5181 - DNA, 218 bp, Bacillus thuringiensis
atggactaattcaatgcggaaccgctctattgttcatcaactttatttggtaacggtagatttccagaacgtctcaaggcacatcgatgatgatgagaatactcattgacctgaatatagacgatgaacatgaacaatatagatcattaacgaaggagtgactattgacactccaaatctgatgtgtaaatggtagaaaacaactacatgaaaaatta

SEQ ID NO: 5182 - DNA, 223 bp, Bacillus thuringiensis
ttaggagtgtctattggattgtcaggtcctccgacatatcctgatgtgttgcagccggatccatttgcttgaaccaggcatgttacatttgctgaatgcgtattgcatcctactgtgtctcactcccatccgacagtttgttttgtagctgctatagctgagcgggaaattgagtatgtggacacatgtgatgaagttgatacagggtttcctaaaattcttg

SEQ ID NO: 5183 - DNA, 196 bp, Bacillus thuringiensis
gcgctgtggctttcggtggttcatttgcggttgatggaatggtttttatagtttctgggagacacgtagatatcagggcagagtatttggtcacggagaacatttaaccgtgaattacaacataattgtttagccggattaatggtcgggaacttcttaatgggccgtgcattattgcatacattaggctgactgt

SEQ ID NO: 5184 - DNA, 251 bp, Bacillus thuringiensis
ccccgggggctcaaaacccccccgggcccgaaaaccttggcccccaattcaaaataaggaaaaggctttttgttttcccaaagggatggggattaccattttaaccccaaggggccgaaaattttaacccacccctccctttttaaaaattgggggcccactcggtatgggtttttcaaagggggggggcgggcccccctaaattgggacccccaaaaaccccaatcccgggcccaacctggggaagaaaa

SEQ ID NO: 5185 - DNA, 555 bp, Bacillus thuringiensis
gaaacattaaaatctttagcgatgtctggcaatattcctccaacgataagctatacaagacctaccgctatcgttgctaaagctaatataaatactttgaaattcattttttatattcccttctctgcattatttaccgtagaacaaaaaaactcctgactacaaacgctaaaagacgcattttgtagtcaggagttgttggttcctggtagagacccccaagccatattcttggagttatacatgattctcatatgtaattaatcaacgtaatagaagataccatattattttttagatttcaataaaaaatttgcatttgtacatgtgatcttattaatcattttattttttatcgttgtaggaggcactaatatcttcagttgatgtgcacggggttaactccatcttttttcatttctttgtagtaatttttaaacacagcgtattgatattgggttaacccgagaatttacactctatgtaatacaaagaaaagtggaggaaaagtgatgggaagtttaccattacatatagaaaataaaaaaaggaaac

SEQ ID NO: 5186 - DNA, 189 bp, Bacillus thuringiensis
attctttctttctatctatacacccatcacaccaatctttttacatgtcccaaacgaagcatacgatacaggtcttgcctcatctgtattctcaccctttgacgaaaacacaacacaacagggagcttgccttgttcaccaaaatgtatctaaagctccaattactctataaagtgacaaagactaatc

SEQ ID NO: 5187 - DNA, 291 bp, Bacillus thuringiensis
tatcgattcggaatcccacaattcggggatttccatccgccgatggtatatagggaccttatttggattacccttcttcttcaaataatggatctggaggcgaaaggtaattcggtcttacctttcggcttttatttttttggggggctatgggcccctggatccgataaatattttcattccatttcgggggctcttcacatatgctgctgaatccaattctatattggcctcaacgatgagggttcatagtagtatttcgcaatcttcaatattcccatacggaattaa

SEQ ID NO: 5188 - DNA, 181 bp, Bacillus thuringiensis
cggtcacgtatcacttttttaatgatacagcaattatgaagatggctaccttacaagattacttggaggatatactaaatatttgatacgaagaacttatgaaggaaaaaggagaaattcgtaatggtatggtagatcatatatgagcacaacaaggaaagtgacaattgagttatgaact

SEQ ID NO: 5189 - DNA, 142 bp, Bacillus thuringiensis
acacgtggtgtcagcgcgcctccgcgctcgaagcgcgtcgacgaatacacatatggaatacactccatttttaggctggcactaatctataaagcccttattcacagcgcaggccgattacagggggaagaacaaattcatt

SEQ ID NO: 5190 - DNA, 401 bp, Bacillus thuringiensis
cgaccactaccgctttatgagctatcccactactaggtgcaggcattacctttactttactaatactgcaacgatgtttcgggtcgggaacaccaagataccgggctattacttggccgaactccactaacaactacagtggagggggtacacccccttggacagtaatgctatcttgcacgtactctaaaccggctgcaaatacaattacaaccttggcctcagcaagcaagaccgatgaaaccgaatcattgtggctacttacggaggctactagatcaccatgctgaggatctctattgtgcactggctgacgggctgaaaactaaccatcttcatctactggctgtattgtcgctggcggttgcataactggatgatccggatcatctacatgaatg

SEQ ID NO: 5191 - DNA, 184 bp, Bacillus thuringiensis
tcatgtgtactagattcagcattattgccggatatttttttattaaatacgaataattacgggaaactatgggtaaacgtatgtagaacatccattgggtattcagaaattgaaacccatagctcctatctttctatcatacaatccattagatgagcgttctgattaaggataccttctacaa

SEQ ID NO: 5192 - DNA, 394 bp, Bacillus thuringiensis
ggacgattaaagctgtctgacatgagatcggcaatgaggctggcgattataagataaacatggctaggcctcgggcgtatatgacggacataaacaaatcccgtgtaggagaagcatacgaatccaccaatgaaccaggggttttatgttgaaacacatgatgcagtggtgcctgctctagcgcatagaaacatgcagagggggatgagatcgtcggtcgcaatttcgttcttgcagggcggatgaaatcctgagagcacatatttatatggatatgatgttaggaccgcgaacgctgagatatgctattctaggggaggcgttaataacgagcctgtgccgaactaatgagggaccgggtgcgatgattgcgtccgctgactggccctttggc

SEQ ID NO: 5193 - DNA, 370 bp, Bacillus thuringiensis
gaacaaatcgatttttgtgaactaagaagcacttctgctaggtaatgctacttgttatggcccagtctcaaaaaagaatgcatttgcaaatactgatattgccgacttattacgtgcacggaccctacaaacatgagtgtatggagggatagcagtccagctcctaccacactactgacgtcagcaccactttaacagtgacttacgctaacacttagggctacttgcgggaagcctttgcgcccgggacgcaacagtgacgcaacttttaatagtaggtcagataatgcgcgcaccacggtcataccaagaggggggcttccgcacgttcgaacatctactgattggaggaatgtagaggctttgccca

SEQ ID NO: 5194 - DNA, 197 bp, Bacillus thuringiensis
aagagagactgtccatttttactcaccttattgccaacgaatgccttgaatgaaggaaaccactctactccaatgaaaccatgaatgacatggctttgccaccccattactgtccaattcaactatggcaagagagggtatgccaaaccaagttaatgattctatacttaatgaactggagggacgggaaatgggaa

SEQ ID NO: 5195 - DNA, 332 bp, Bacillus thuringiensis
ggtgctgacgaatgatcgtacatgttttatcacgcccttattttatggtgccaggtattacggatagcgaagagaggcataaagcctcatatttctacttactagcgccgtttctgatcttaagcgccgactgtaaccagcctctctctaatacgttaatatgtgatatacgccatcctatacttttatcatacgtataaaaaggtctatcacatcgggggaatgttacttgtatatctcaaaccacgccggcaacccctaggggaccacccattgagcctaccttgccaattgagacgagaggggctactgtgaataagagattaagtggg

SEQ ID NO: 5196 - DNA, 339 bp, Bacillus thuringiensis
gtgctctcgcggcggccgatgcagaaactaacggttgttccgatgccgacaatgattacacagcacgcatgctgtactgcctggtggaacactgaataatgacaactcctatataccaccgaagattgtcataccaataatcacacctgaagtgcgcattgccgtacatgatagagccgacaaatactgaggtggatatagaataatactgggcacctatgtatacggtgcgaagaaatcggagtgagctctgtgaatagcctgtataatgaaagtatgtataattgcgtgcagatacactaaagaaaccgtcgctgctaatatttaatagtatatctg

SEQ ID NO: 5197 - DNA, 250 bp, Bacillus thuringiensis
gcccccacgcgggttcagctgcctcgctcgcaagctcgtcgacgacatacagatattaatatgtggctttggttcatcatagtcatatgaaagctcaggctggagagatgaacacatagcataccctctttacgacctagaaagtgggcctaggtaaggagactttacctgagtcaaatatgcacccataggccatatatgtcaatcgtaagtccattaattttctgagagacattacactggaacgtaa

SEQ ID NO: 5198 - DNA, 225 bp, Bacillus thuringiensis
cacacttcgtgatgactatcaattgatgattacgaatcttcatataccgaattttttaaatcctcatgcttcctccattaagcggggctatttacggaatatcaatcccaacatcttccaacagaactctgctgcttttcagcataagcaaaaaggatctgactctcaaatgagtgtgagagtcttcctgggattgtaataattaatgcaaacttaatcgcaaat

SEQ ID NO: 5199 - DNA, 215 bp, Bacillus thuringiensis
agtctctttttctatcgatccacccttcacaccaatctttttacaagtcgtaaatcaagtaatggatacgatggacgctgcgtctgtattttcatccaaagatgaaactacatgagtaaatgtggcgttccttgcataaaaatatgactctgaagttccccttgctctatgaactgaaaaagacgcatctctattatttggcacaaacgtctttt

SEQ ID NO: 5200 - DNA, 214 bp, Bacillus thuringiensis
ggccgggtaaggttttttcaacaacgacattgttgcctgcaagctggggtctagatatgattaataaatggctatcactacgttacgtgcattcgagcggaagccattatctcctcaacaccttttcccttccgatcaagggctaaatcatacatccaactcctacgcatgacagtgggagaaattcggattagtcagcagttattgtagacgt

SEQ ID NO: 5201 - DNA, 324 bp, Bacillus thuringiensis
cattttgctttctttgtttaaagcgactcacgctgtcctggtattttttgtagctctttactataatgctcatggcgagaatgcatctagtatacagacttgtccaccgatagctgtgtacacccaatccatcctgctagtggggggatgatgtatattatatgacacaacagcgggggtcccattattacacccatcacgacttgtgggcccactccatctctcatgcaactctgaaagctcacgaaccatgagcgcatcttcttgttgcgctaatactcctatgcacacgcgataatcttacacggtgaacgcttgtctttc

SEQ ID NO: 5202 - DNA, 280 bp, Bacillus thuringiensis
ctttcgtgggcagcttatcttctcttttggctgctccagtattggtatagagtatcaacggagtaattcgaactgctatttatatctctatcatttcacagatcggtggtactccaataatgtcataccacttcggttatttatctccatataacagtctcctcagtctcttatacgttccatgataatctatcattgcttgaccatggagcagttatcattaaactgggtctgccaagggccccctgtgtcgactaccgatatgccgatgtataatgac

SEQ ID NO: 5203 - DNA, 154 bp, Bacillus thuringiensis
atggaagatggaccgattttaaccatacacatgcggaaaaagctaggggggtcacgaatgacatatgtgcgggggcggtatacaatgtcagatgaagcgattacaggttccatttggattctcatgaatagagaactgatctttttgagatcca

SEQ ID NO: 5204 - DNA, 227 bp, Bacillus thuringiensis
aaattctttttttacaaaacggtttttacaaaaaatggggtatggcccactattcgtgtatccgatccgtagcggagaggtgccttcctggaacccaaccttgcactttggggagcgggataaacggtggggggaacatgggctatacctagcccacatgtaaaaatgtatccccttcaattttccaaagatcttaaaacccggaggcttaaagtctaaaccggggg

SEQ ID NO: 5205 - DNA, 105 bp, Bacillus thuringiensis
agcttccagggggaatttatttgcctttcaagctgcccatctgttttgacgggctatcgctgctggccttttctgtatgacgccctcacggagtgtggatcctat

SEQ ID NO: 5206 - DNA, 263 bp, Bacillus thuringiensis
gaggcgcactgctgtttgtactgaatgagaagaaaacatactagcttagcggaagcttccgacatggggtctaaagataaagaataccattgcacgataatgaatagggtgagcctgtggtggcagtggagttaatactaggcctgttatgaatctttgagcttggttaggcataattcctactgtacgaagacttacaggcgacgtacttggttgatcttctcaaacatccgtgactctgccagctataaatggtgggacgc

SEQ ID NO: 5207 - DNA, 253 bp, Bacillus thuringiensis
accggggggtaaaaacctgcccagggcccaaaaggttggcccccaaatcaaaatttccggaaaacaactttttggccaggggggaaccacaattaagcgctcggatccaaaccgctgcgccaatgtggttggccccgcccttccctaaagggggttcgttttaggggtggggaaaatcggggaaaaaaatgtccccggtgaaaaatggttccccgttccaatttccacacaaaaagggacccgaacctttaag

SEQ ID NO: 5208 - DNA, 196 bp, Bacillus thuringiensis
ggcgagtgataaatgcgtaatcggttcgctcagactgttacggggatggagttagcgactatgaggcgcacgatgcatgctaggaacaatcaagtccgagcggctggatagcttgaagaacctgacaaagtacgagccccgacaaggaatatagggctcctaagtggtattgatgtattgctatgtggatatatta

SEQ ID NO: 5209 - DNA, 148 bp, Bacillus thuringiensis
atcggtatatgatccgttatccactcccatggaaaatatctgtggtcggactttacattctaggcagatatgcactgaacttctatttacatcctaccgcacgcaaagacccgaagctaggccctttgttagatatcgtgtatacccg

SEQ ID NO: 5210 - DNA, 141 bp, Bacillus thuringiensis
ctgtcctgcgttatcctttgtccctactgcaaaacgtattgacgtctggacgtgaaacgatactgtatgttgaacatcaacgaattttcgatgaaacagattcaactgcggctctgactgctagggattaggctacatccc

SEQ ID NO: 5211 - DNA, 149 bp, Bacillus thuringiensis
ctactgtacgcgctttttttcgatactggtgtgcaatctttaggggagataaacttgtgacccatcatagctgaaaagtgtcgcgaaagggaatacacggagcagtacaggcaacttgtaaaaagctgtgcttggcacatcctaataat

SEQ ID NO: 5212 - DNA, 105 bp, Bacillus thuringiensis
tgtgtttgtgctttttttcgcttcagctggactcgtcatatctgattgggtgcttttaactcctgccaccatgatggtagttaaaattgttttaccggctgacag

SEQ ID NO: 5213 - DNA, 224 bp, Bacillus thuringiensis
gggattagctcgattatttttcacggatttatctaaattcttgcatctttaattgtttcaccgattgtcggtgacggtcgtgagtatacacactgcccgtttcaaagtacaaactgaagcatagtctacttaaccgcgtgtaatgacttcctgatctgcccatttatcagtgggactgtctttactttcaaacgctgagccaatgacacgcacaaagcaacgaa

SEQ ID NO: 5214 - DNA, 186 bp, Bacillus thuringiensis
cacgcgtgttggacgagaacgcccctgcgctcgagacgcgtgtccacaaacacatatgtgaggccggccttattatctctgaagctcgttaaggcgtgcatggggtgaaggacaaccccttcctcgcgtgaagccatttatgacatacgcttgccaaagagacacggaataatacaggtatcgcaa

SEQ ID NO: 5215 - DNA, 230 bp, Bacillus thuringiensis
ggagctaataaaaatattccttgggagcaccagatgaggttttttacaaattattcttgacccttcggtgcaggtgctccatcagttggggaggcggtgcttatcgtactatatggtatcgagtgtgctgaacttacgggacgacctaattgtctgctgtaggcggacgccacaagcaacttgttggggagcaggagctgctgattaatgaatctaacgcggcagaccgt

SEQ ID NO: 5216 - DNA, 149 bp, Bacillus thuringiensis
agaggaatggaagctacgatatttcattcctggcgtacgaagtcctccctacaccgattaatgcacagccaggggagggacatttcctctgatatacctcccgacgctcctttaaattcaactaggttcagctttaccactagcaattt

SEQ ID NO: 5217 - DNA, 153 bp, Bacillus thuringiensis
tttatagagattactagattataattattataaattagtaattgatatcacataacaactcaaaaggagattgatcataatgaacaaacaagtaatcgaagtattaaacaaacaagtagcagactggagcgttttattcacaaaacttcacaa

SEQ ID NO: 5218 - DNA, 143 bp, Bacillus thuringiensis
agagtacatattacagcacttatttatgggaataagactcacgttgatactgcaaacgattgagctccttcataggattgttgactacagtaacctgatcaccgtgaatctaagagtgtaaacgtaccattaataccaatacg

SEQ ID NO: 5219 - DNA, 149 bp, Bacillus thuringiensis
cggtgggtttaaaggcccccccgggcccgaaaagcttggcccccaattcaaaacccttactaaaccctttttttctacaccccaaaacccccgtcgcctttttaaaagtctcgctatacgggaattggggttccgtaaccaacccgttc

SEQ ID NO: 5220 - DNA, 225 bp, Bacillus thuringiensis
gcatccatatctctatctttcttttagtctcatattcaaataaatatattcaattcgatgagaggattctactgtttaatattttcaggaagaccaattttaaatcacctcgtttgtcactaattttcacatgactcttcttctgaatattatcatctaggaataattattattggtctaataaatgggttgactcttattattctgagctctataatgagaatt

SEQ ID NO: 5221 - DNA, 214 bp, Bacillus thuringiensis
tccctccattgtcctttattcacaaccctaccccctctattacctgcagcgcgtctttattcacgctatgctactacccaacttgaaacatccttagagatatttgctgccttttgctggaccgttcatctttccacatcatcctctatatgtgccgagctcccctgttatctacggatccgcgtccgcagacgcctaccatttactaactacc

SEQ ID NO: 5222 - DNA, 110 bp, Bacillus thuringiensis
ttcgagagtgccccatccatcaacactttctgggtgtaaataccacttctatacgatgggacaataccctacatgcccgggtcgttttccgcaaacatctcgcgcacacc

SEQ ID NO: 5223 - DNA, 443 bp, Bacillus thuringiensis
ccaacaaggcactgatgctctaaagatatctgttgaatgccctccagacatcacatgcagcactgcgtgatggctaaaacttcgtgggatgctgaccatgacgcgctatgacataccctctacccactcgcggccgaaggctaacacggacaatgaggtcctacgacagcatgagcagatcaggctcacatcggaccttggtgtttgacccagtgcgttcttacgctgaccttatcactcagcgaatggggtcactgggtactccgagaactattcatgaaaaagtaacattacgctgacctgccttctgaccacgaacggaaagatgtgccggacggcgtcatgtctacgtgtccgatctgttaaccaatcatgtgtacgcaagaacatctcacagagttgaaaggatgcgagacttgtggatatcattatgctatgaatgc

SEQ ID NO: 5224 - DNA, 299 bp, Bacillus thuringiensis
cgcgcatgcggctcgcatccagcaattcgggatccaaaggctaccgtgagagaagtgaaaactagccaggtctatacttgctgagaataattgatctaatattacaatacttggtcttcctggacttatcattcatacatctgcaggcctactcatattagcagctccgacactcatgaaaccggctgcaaatgtcttgtaattacgctgcttggatggccgattcaaccaatgatggttacacaatggtatatgaagtatgctccggaggtatcgccctagttatgatatgatcacct

SEQ ID NO: 5225 - DNA, 135 bp, Bacillus thuringiensis
gtccgctggtacctcagcattgcgcacagtggaaatgctttcgacccagataacggtggtgggacttgtgcactgagttaaatggcagggacatgattcaccaccaacactaggtgtttgatggacacacttccg

SEQ ID NO: 5226 - DNA, 174 bp, Bacillus thuringiensis
tatgactgtggcagcttccggataagattgaggctagtgcatttcattttgaacccattaggccacttttggctgagctcattctgaatcactataatataccaagatatggacgcgtggtgcacaatcttggaaccatagcggactatgatagaactgggcctgcatcgactg

SEQ ID NO: 5227 - DNA, 268 bp, Bacillus thuringiensis
tctagctgtgtacctagtaaaacaggccgtgtatatcctttctgaccccgtccagggggtcctacatctgccgggtttttatgcaaagggatagcatcaccaccatagataggtgtttctgggtatacaactaggacgccatccttttgtgcgaaacggtacatgcggtgcccatgacggctgtgcttgatccatggtgcttctgctttgacctctgaagaaaacggcgatggttagacaatttattatgttgcccccaatgctttct

SEQ ID NO: 5228 - DNA, 244 bp, Bacillus thuringiensis
ctgggctctaccagtgaacgtatgccatacatcgtcaatttttgtaataggatcagcggtaacttcctgatcgaagcctgcaggctctaagagctcaccaaggctcgatgaaccgcttaaaggctaaacttttcctcagatagtttttagtaacctggttttaccaacaccgttacatcctacaataccattcctttcaccacgttcaataatcattgatagctttggtcgactcggttgtgta

SEQ ID NO: 5229 - DNA, 182 bp, Bacillus thuringiensis
tctaaagtaagacggaatacatttactccaagaagaccacttgttataatatacgacgacccttaaaactgatacacttactgatagagataccatattcatgagagaaccaaaaatcacccgatcgacggtaatgactcaatagaacacctcatccccgttgtacaaaacgcgggtgggta

SEQ ID NO: 5230 - DNA, 299 bp, Bacillus thuringiensis
ggttgcaccaggtaaggcttttttagcgaaatcgatatggaaataagattgaggcatgaaacctgcaattgtgagtacaagacctgctgtagatctttcgcttaatactgcgtttcctatgaattgctttacattttacctcattaattgttcaactactaccggactggtgagtctgtcgctagcgatacactgaccgttaaatattttacaattgactactaaggttgccttcttaattactccatttaccattcattcatcatctattttttatatgcaaaatagcaaacccattc

SEQ ID NO: 5231 - DNA, 204 bp, Bacillus thuringiensis
gatatccctgcgttagtactctatctgttactttctacacgaccaatgtctcaagcctagcgttagcacgatatccctctcctgatgctacctcgcaagcatgtataatatcaggatacgatttcgtttacccgtgtcaagctcttccccaatccttgtactgccatatacttctttaaggatcaccttacagttcacaacccg

SEQ ID NO: 5232 - DNA, 389 bp, Bacillus thuringiensis
accgtggcactcttgggtacgacacataggatgccggattctgtcgggctaggtctgcatgggtactacggcgcgcgggtctatacgggtgactttaaagttccatcaatcgccacacgaacatagtggagcttaccttggggacatacgtcaaatctgaaatgaaggcgtcctttgattactatcggctgacccaatcgcacaacgcctaggattgtcaggaccagaacaggaagacggagtagagctatctctagtactccttggctcggaaggtggtcttatcacttcctgtgttggcgtgaagtgtacaatgggctataaaaaggataatgatgcacgttgcatgcatcattgatgatcttggatgtggatgcaaggacttgttt

SEQ ID NO: 5233 - DNA, 100 bp, Bacillus thuringiensis
gccaacaatgtcttttaaatcactattactttcaactgatttgttacagacattctacgtgatctacttccggggggttctgtttccttaggtacaaact

SEQ ID NO: 5234 - DNA, 268 bp, Bacillus thuringiensis
cggctcttctttgacttatgcctcttctttaggctttactttttcttgcgctttcagatcttctttgactttggcctcttcattaggctatactattatctggcgctttaaacttactaaatgagacatattgcactctgggtttaggaatacactaactttttgcgaatcatcgaaagactcatcttctgcatgccgtgtaggctcatctatttacaggactccccgacacttgtttagcgatagtactgtcatttctgacgtcata

SEQ ID NO: 5235 - DNA, 340 bp, Bacillus thuringiensis
gtgcgttcgatcatgtttggagttaacatatgtctataaagacagggattttattcacttatattgctggtatcctagttgtcattacgctaatatgcgtacggccattctttatcgactatatgcaatcagggctctagtgatcagtataaagcacgtataaaggtccttaccttcgaaacctgtttacaccaggataagacaatgcctatcttgggatgacgcatcggccaaacagcgtcaatgctaaattgcttgatgaggcgttacgataatcaatagaacaatagggtgcgaaactagtatcaagaaaaggagaaacactttcatgtgcttcaaa

SEQ ID NO: 5236 - DNA, 203 bp, Bacillus thuringiensis
tggttgacattggatcttattcggttcgctaagaatgcgagggggatggagttaaagccatatacgcgctgatcggctagagcgccgacgcttaatctcctgtaaaacacatccgtttggcctcattacagttagagctctctatatcagaagaggacaggaacaaaggcgaatgccgtcggtcctttttaatataatgaaaa

SEQ ID NO: 5237 - DNA, 224 bp, Bacillus thuringiensis
tatgctgcgtgcggtttatgtatcgttcaagatcacggtagttcgcttgctatacagggactaggcgacttgggccatcgagttgcattctgagactatgcagatgagacacatggacgagctgcctgttttattacttaccgccttcatgaccatcatccagcgtttggagaccgtcttgtaatgcctataacgacgacacttggagggtacaacggcaaggg

SEQ ID NO: 5238 - DNA, 230 bp, Bacillus thuringiensis
tattagtactcgtttgaatccgcgatggtgcgcttgttacttgtttgcttacacttgacttacttatcatgctagcacgctgtccccgtaatgctacaacctctccagcatatgtaatataatgagaagagtttgttcagttatagcctgtaattacgatatctgtgtcggactataagcactcctggcataagttgactgtacaccacacgactggtggccgcatacag

SEQ ID NO: 5239 - DNA, 422 bp, Bacillus thuringiensis
cgtgatgatgtggacacgatgaatttccagcatttgttaacacattttatataaaatggagcgatttttatcactactctgatccgtagtggatcaccgacactattcgcatctaaagaggtgcgcgtgcttgctgcataacttgcaggagctgtggcagggattattaatgtgcgtatagttacacctagcgcttgtttagctgattcaattacgcctatgcaagacggatacgtaaataaaactggtatcgaccatattgatagcttatcatagcgcggcggtctgcagagactgatgatgtcaggagctcttatttctgtaggagattgtatggaaagattctttcaaggtatggatatgatagcgcacaatgatgaatatgatctctagcttcggacttactggtgcacgcttaaata

SEQ ID NO: 5240 - DNA, 274 bp, Bacillus thuringiensis
gacgcgttttttggatccatgacatccgtgatgatcatctacacagtcgttaaaaatcagaacacttactatttttttcggagcaacccatactaaagctattgagggacctagttaagcgccctcgacagttgcataaattgtactttcacatgatgggggactggaaggcaataacgttctccctatagggcgtgaacccaataaagcttccgcggcaaaggactcacgtgttagctttgggcaccaacgcatttctcgacgccccatgtgt

SEQ ID NO: 5241 - DNA, 271 bp, Bacillus thuringiensis
gaccatcatctcagacgatatggaactgtacactatcagctctttatgcgtgagtcaggacttgagctattgattaatctcgaaaaaagaattcgtctaatggattatatggaaatacatattctctgtctcggtgaggtactatcatgcacaccaaagatcgagacaacattataccttgctcggcaaaagacttatatcactgctttcggtcacgacccatatctggcgccccaagtgtattactatacgatcaacttcgcactttctg

SEQ ID NO: 5242 - DNA, 231 bp, Bacillus thuringiensis
tcgcattggtgaagtttttgtgacgccctcggcgtgtttgttcaaacctataccggcatgaaacacttgtgattgtactggttacacccctcattcctcaaaacgatacacagatggcttgttcgcacgccgcttgatgccatatccaggatagagcagtacggaaaagtactctatccccatcgtgcatatcggcggagtacaaggcttctataggtggtttgtcgcctg

SEQ ID NO: 5243 - DNA, 104 bp, Bacillus thuringiensis
atgataaggaagaggacttttaatatataagagaaatgcctatcacaaaggcgagtggatgggacaactcaaggaggaaacgggcatactgttagctttaaaaa

SEQ ID NO: 5244 - DNA, 329 bp, Bacillus thuringiensis
gggcgtaaggtggcctttataccatcttggacgtctggggcctgagaagaggctccagctgtgctacttcctattgtttgggcttctctaccactcatggcgtgccgcgcaatctacgcatggtgagcggaacacaccgcaaacacaccacgtagtttgaacgcctagggtggtgagggtatgctgacgcatctctccgattatggtggcgactttatgatcgaggtgctgtgcatacacggtactcgtagcagaacgagcatcggttacagctcttttaaattgagaaacgaatgggtgtgattatcaatacaagttatgacgttttg

SEQ ID NO: 5245 - DNA, 363 bp, Bacillus thuringiensis
gctaccttacgcctgatcactctaggactgataagctactttattgaaggaccattcaagctcctgcggtacacgctaagaggcgccctcccctggcgatcggcctgcctcacagtggatcccagtataccttaacaccttcgatgcaacataaatacgttgctgactgtttaacacattcacgtgcacctgaactagttgctaatgatccatgggtcccgcactccactggagtggctgcaccataatgctggatctggctcgctaatctcttcacgtcttgtaaatgttatgtctgggctagactgattctacacatgagctggaggatcatctagtgtacggttgggacagtgccaagat

SEQ ID NO: 5246 - DNA, 348 bp, Bacillus thuringiensis
gttgctgggctatgaactgatgcagtcattggacaaatttttgcctaatatctaggttttgtatagaagatactgagccagcctgtggatcccctggtagtgggtccgactttgatatagctggatgctaatatggcaccatgcgccactgagaccgcctgcagctacggctgagcacccaatgcaagagacgactggcgcgccggcagatgtgtcgccgaatgctgaacatactgtatcactgcacgggttaccaaatccaaaccgaactatcgcatcaccagctgattgaaaaatggaccgggaatgaagaatctagttaagcgacgtactttgcatatacccgct

SEQ ID NO: 5247 - DNA, 231 bp, Bacillus thuringiensis
gaaaggaggcgattttttagctctgcttcgatgaaaaataaataacgcgctttttgcacttgtcgcgcattaacagaaaccatgctacctatacatactggccggtttggtcttattggacgaacatttaaatcctttctttttcaatgcgtgcagagggaagacattaaaaaagcctctcgagccttttataggaaggcaaggttctcccatgaagccaattgaaaagtt

SEQ ID NO: 5248 - DNA, 412 bp, Bacillus thuringiensis
  unsure (1)...(412): unsure at all n locations
gactgatgggtgagttgttttcgctggctgagtacttagtccatacgacgttacagagcttggacctgacctctgaggtgtcatgcttaatgctgtttccggaagcagtagatggtatacctctctcacttcattggactatntccataggtgactttggtccggctataaaaagacaagtcggtgtcatgaccgttttcggactatcaagagagcaattacactcgactagtatttatggagactatgttaatcgggattttacctatcttgctcggcctgcagcatggagtggtattatctcagtacagtgtattagctacagcctaacttgcgcatgttccatgaatatatctatacggctctaccaacgccattattttaacaaccatcgtattccttgggctttgta

SEQ ID NO: 5249 - DNA, 395 bp, Bacillus thuringiensis
tacagtagcgacaggtgtcgttactgctgatgcagagagtgatcccactggcgctttaactggtcctgcatcttgaacgcatcgaccgtaacgggcgcattaattcatggatcatgctggatttgttgagccaagcgcaaattatagcctacaaggcgagcatacggataatgagccagacgcactttatcacgcatgtccaagtgcgactaccacgacttcgggaggtactttactgagtaatggccacgacgttgtgactgatgcatcagctgtacagcctttacgagcattatctaagtcaaagcttgaaatagcgttcgcaaatgctgttacgtctgtagaggaaacaatcgtatccgcgtgaatgctagctagtgcgctctgcttgagag

SEQ ID NO: 5250 - DNA, 185 bp, Bacillus thuringiensis
ttcttatattagcatggttattaacttctaaacaagatgtgtaaggcgcagcctatgcatatgtaatatataacgttattactactattgacttgattgagtatttaaagaagaaaattgacccatttcaactagttggcacggatagaaatttccttgcacagggtggggagttattaaagcta

SEQ ID NO: 5251 - DNA, 314 bp, Bacillus thuringiensis
caagagatggatagatcacgcaataccaccacaagctgaatatttgggtaccaaccctgagcgcaaacaagacgggtgtacacattttacatttcattgaatcgaccctcttttcttgagtggggcatatcgatttgcagtatggtgaggacattcttatcacccggctctaacgtacggatcatcaggggttgactacagctgcagaatccccacgaaggcatgagctattgaattagctggactggataagaagtgttgtggcgtttgtatcgcacgatgtttgccaactgtttatcacgagtctgttatac

SEQ ID NO: 5252 - DNA, 106 bp, Bacillus thuringiensis
caaacgagctctagatctagccaacgcaagggaggctgtttttttccatagcgctccagaaatggtcattgcatggcaccgactaggggctggcatcaagtccacc

SEQ ID NO: 5253 - DNA, 109 bp, Bacillus thuringiensis
ggaccatgtcaagacgcttatgtaatatgtatcgagcaacatggagataaaatgactgacattaccaatattgaatccgaaactccacgtagatagccgacatgctgta

SEQ ID NO: 5254 - DNA, 310 bp, Bacillus thuringiensis
gtcctcattataacctacagcttgctcatcaccaatggattccgtgtgtggacgactaccatatatattcggcgcttagcttttagagcctccgttcatattctgccacaacctgtgggcatcgagctctgggtctctgcattatatacacgcacattgagggacggaaggtcacatgtcgttgtgatacaacgaacgagactcgtaaaactgtgacacaacccaatgaagcgactcgaccgcatttatcgctaagcaagatgaagtaatgctaatcacgtactggccgatcggtcttccatacagaact

SEQ ID NO: 5255 - DNA, 121 bp, Bacillus thuringiensis
tgcagcaatagggtgcactactgtacatacctgccattggtttatacgaggcccttgacccttgtgaggaaccgccgagtgaaaaaaaatccggggaaaggctaagttaaagggctgctat

SEQ ID NO: 5256 - DNA, 281 bp, Bacillus thuringiensis
gaagtccgtaatgcatttatttcttgctgcgacaacgggattattaacgacggcggattaagactgtcaagaaagtgtgactatttaagactcttgtggccaaaaatagagagctgtatccaggctatgcacttaaagggctattaactgtcattgcataagctgtccaaagagaaatgcacttggggttaatggcatgaatctctgtcataaccttttacctgagacttatgtgctaactggcgaatggaaattgcattcgtttaaaactgttttaaatg

SEQ ID NO: 5257 - DNA, 118 bp, Bacillus thuringiensis
tcgcgagatccgctcacaattacagacgatacacgagcgggtatcttactcagctgactgacggaattaacccgggttgcggtcataacgcatttgcttattggactggatgctgcat

SEQ ID NO: 5258 - DNA, 257 bp, Bacillus thuringiensis
ctttcgagaggactccctattctacacgtaaatgaaggtggtgaggtgaatcgtcaggactactacagttgccagaaataaactggccccagcgttttcactcacggtttattgctgcaccgcataatcccaaatcatggacccgaaacactacgcgttctgcatcaagcctggtaccaagcctacctctatagtgagccctattacagctcggccgtaccctggtcctagttcacttcctgtcataaactgctatc

SEQ ID NO: 5259 - DNA, 234 bp, Bacillus thuringiensis
cgcacacagaagatctttttttcatcggtaatattgttgccaaatcatctaaattaacacacgcttcatatggatcgatgcctccattggatgaacgtcttataactaacgaggtagaaggccgaattaaagcataggatggcaccattgattcactctattggaaatacgatagaaagccatgtgatacatctgcatcgcaaattgctcacattgtcttaacgcgcgcatcat

SEQ ID NO: 5260 - DNA, 360 bp, Bacillus thuringiensis
atccgggatctccgatccatacctaatcataacggaaaaccacatttgtggctgctacggcgatggctgtactagcttcctcaatgcccatatacgccattacgttcttactactcttattgaccgtcacatatggcctcacttaacgaacgctactactgcgtatcataacgcggtcgaagtatcacaatcttacgcaccatgagttgctgtatgtgattttatttcagatgatgcaatatgaattgcagctgtaataacatctcttactacacgaattgcatctagaagagaattaccaacttctggctactaaacatacggccaactattgatatatgctataagcctaagacggat

SEQ ID NO: 5261 - DNA, 428 bp, Bacillus thuringiensis
ggaatacgaccgggcattacctcatctaagactggatagcttttttaatgatccaacttgagccaacggatgacgtgctccactcactcgaggtgacttaccatccaatttatctgtcttttgactgctcacaattcctggcgttgaagacttcctattaatctcattcgcctctgcttttactctagcttcatcagtggcttcctctgcagtaattgttaatggctctgagtcatgcgctgcttgctcaaggcattgccgagcttctactgctccatgaatcgttaccgctgtctctgcgtctggtgtatgtgcttctaacgacgctgacgctcctaagaacccatgataatctaccatttctctaaattcctattcgatcgctccattaagctaactttgatgttgggatccctcaaaaactgaac

SEQ ID NO: 5262 - DNA, 238 bp, Bacillus thuringiensis
gaacggcgaggctatgatgctcatcttgcagttatgctcttttctaaatcctacataagcgcccgcaaccgcggaaagggctactgatcgaatacatgacacagcttctggaccactgaatgcaaccactgtatgtcaccccatcgatattacgtggcaaaacacgtccggactactaaggtgctaacccttgcaatgaggaagcaccgtcctgcgatttcttgtctcgaaatgtgca

SEQ ID NO: 5263 - DNA, 196 bp, Bacillus thuringiensis
gcgaggaatagacattcctcccgggacacccagcccgccttttttgaccagtggcaatggttacattgtagggcatccatgcattggtatgcttccattgataaatagcgcgggagagcggcatttataagtctgtaacaccttggtcactaaaatggcctgcaactaagtctacgttgtgtgaaggggagcactt

SEQ ID NO: 5264 - DNA, 230 bp, Bacillus thuringiensis
cacacgtgtgttactagagctaccacgctgctcgagacgcgtcgacgacaaatatatgatattgggacgctcgtttttttttttctcgatacattgacacttatgatgacaccgggcgatcgggtttgcctgcatagcccgaattcagttctacttcaaagggcggggaattttccctgcgtatatacacacaaatctaagggggaattacccccaaaggaaaacaaacc

SEQ ID NO: 5265 - DNA, 130 bp, Bacillus thuringiensis
tttctgtgtaacaatacgccataacctaactgtatatatgctaaatctaaagatgctgacgcacgggcatttttcccaggccctcgcaaaaaaaagactcatatcgcacgacctaaccaaaacgaagaat

SEQ ID NO: 5266 - DNA, 280 bp, Bacillus thuringiensis
cacgtttcgtctcagctgggcccatgcgcacgctttttacgatctacatatttttccgtgtccaacgttataaattacatatctctgcgaaggttcgagcaagaggctcctccacttaaatcacggtagatgaattctaagacgtcggtacggttattcttggaacattgggtctagcacgctctctcgacttgattggtatgctcacagctgagcttcgatcttttaaaggcctttttgttaatgacatatcttttctaacccgccgcagctttataca

SEQ ID NO: 5267 - DNA, 282 bp, Bacillus thuringiensis
gtttggtatatcacatttactgcatcatacaggcgcttcaaatgcgccttgtaccgggcgaccatctcccttatatgaatccttacttcatacgcaattcatgaacatacgactcgtaacatcgcctaagaccgagaacgacattggtccaatatattatacgggtgttctttcatggcttatcgctctaaggtgaaatgtctatggcgacgcgcaatgcgcggggctccatagcgcggccaatttatccaaggacggtaaattactgtgtgaatccataag

SEQ ID NO: 5268 - DNA, 308 bp, Bacillus thuringiensis
gagtgaacatcgaatatggcatatatggaacgcttgttaggagcgtactagttgcacgaatcgtcggtaatatgctacaaatcgttcctaaggttctagcaggagccgtggacactagaataactgcggatgtatgaggaaaggtcgctgggcttgcttgaagaccaactggtgttgtaggctctctcggcgttatgggtgtgcgcttagctggtgttcgatcttttaagggcgttgatatagatggcgcatcgtcttcaagcagacgagcctgtatacacatctcggcatagctttgtgacacagga

SEQ ID NO: 5269 - DNA, 180 bp, Bacillus thuringiensis
gatgtatagtactcatccgcggcaaataatgcgtaacgcagctcattctctaaccaagaagccgtattcggccgacctccttattcatcaacataatctgccggggctggggcgagtgtggatgcagcgtgcaacaagacttcactagcaagaagcgtggcctcaatctctatgacgcta

SEQ ID NO: 5270 - DNA, 208 bp, Bacillus thuringiensis
cgatatctaggcgcaatttccatataaagctgccttgaagatcgtcatagggcagcgctgtacatgtctacattatgcgttattgaaacggctgctgtactcgctgcttgtaccgttttacgctgtgggtcgtcatgcggcgagcggctccagcttccttatggggaatgtttgttatccccaggttcaggagttcacgcgggtttcc

SEQ ID NO: 5271 - DNA, 418 bp, Bacillus thuringiensis
gatgccctttaagatttggtatgagcgcggtagcatgttttttatggcgcgctacgggcctcctaagacgcttctacaccgctttgatccccgcctccagatactaagtatgccgatctgttgacattactgctgggacgatgaacgcccgcacggtacgacgaaccggtggaacgaatgctatagcgagccgcgtaacctctacttgatcataatgggttaggactacacgcggtgctttcaggagagcgaatcgcattagcagtatgataatgcggacaagtacatgaaccttaccgcggggtatatctctgatccataacacccgttctatcagattacgatccgtgtgacgaccgtgacctattattgctacctaggttaggtgattggtcagatacagcgtgcgtttattcgt

SEQ ID NO: 5272 - DNA, 331 bp, Bacillus thuringiensis
aagctcggatacgaagatagagtattatccaagattgaatacgctgtatgcttagatttggtgacggggtctcaaccattcatcgtccatctaggggaaacatggtgttgttctatggacatgcggctatggtgaaatacgcactccgatattaggggcgtctactgaatcgttttttgatggcaatatgtgccttcattacacgtggacgcattagtctctaatttagttggtgcgctgattgccattacattgtatacactggcctggatgaaccgactgcgcttattatattaattacactcttacgtattccattttcagccccaat

SEQ ID NO: 5273 - DNA, 339 bp, Bacillus thuringiensis
gagatctctggttgctatccatgtttctatgcattacttatttgggtttgagtaggcttagaaggggctcaacatccgatgctcaactaagtgcaacatgatccgggcgcttggtatggggaaactacttgtcactcaccgaccgcatgacgtatagaggcgacggtacatccatggtttgacatgcatcatttcattgcagacgcgaggacaacagggaccatccatctgttccacgtgtgtaaacaacaactggttctcaaccactgttaatagtgtcgcactgacaatagttgctcgcatgcgctctctgatgaatcctatccagctggctcgcgc

SEQ ID NO: 5274 - DNA, 292 bp, Bacillus thuringiensis
ggattattagacggagctccttcagaacaggacacaacaggccagtgaccgactattacatactaagctgctttatgagaatgattgaaagaccacgccgttgctatcacatctaaggcctcagatgctctcccatctactctagatacaacacggggaggcacaactgtttaatcacttgctgaactcagctgatggcaactctgatacccaatatagttcatggcgaacatctcacttaacagatgcgttattctactgtcaccaataagaagagccctcactgagactg

SEQ ID NO: 5275 - DNA, 191 bp, Bacillus thuringiensis
ttcaccatttaatgcaggggcacccacagcacacttaaaaggattaggggatgtgtccgattacaactccatcatgtctggagatcatagcgcaactagtgctgctattgaaagtgctatacctgttcataaacgtatctcctcataatgtcatacggtgttaccatctgcacctggagcacatctctcat

SEQ ID NO: 5276 - DNA, 153 bp, Bacillus thuringiensis
ataaagggtgattgacagtttttctaaccaagctacctcctctttatcggaacactatcttgcatataagcggggggcattcgtgtttaaatataactcatgacgaatatgaataaacctttctaaccctgccccgctcccattaatgcaaag

SEQ ID NO: 5277 - DNA, 366 bp, Bacillus thuringiensis
ctaccagttgcactacgtttctagaaggcataaaaacatataacctaactacctaacaggggggactgactggggacatccatggaggaggaacatccacagcattctgttcagcagagtctgcacaatgctatgctcttaaagaatctccaggaacatgtaaaatgatagcggctaccgtaaccgggtatggatgctcacacgaaaacttaaggctcaccacactggtcgaacataccatcacgaactgaagggaagctgggctatacacctggctctacatgagtagatcaatgcttcatgagtgaaaatatggaagtatcacataatcatgatgcaggtattaaccatgctgcactaccagga

SEQ ID NO: 5278 - DNA, 277 bp, Bacillus thuringiensis
ccccaacccggtattttttacccaaccagcacccatcttacttggggggcaacaaagcccacgctccccagcttacgcaatatcgaaaacgaccgctcctaagcgcgcttacccaacaagtgcgcaggctcacaggaacttggcaatcgtatcgctttaggatcttgataggctacgggatagagctaacatagaatctattctcttcaatcaaccaatgcagccgatattccggcaatcacttccacccaaaaaacgcaaacactacaccctaacg

SEQ ID NO: 5279 - DNA, 166 bp, Bacillus thuringiensis
agactcgtctattaattcacatggactccgacacgcaatttttttttaccaactatcagggccctgacggaggggacttaaccattacccttaattcattatgttgttgtattacgtgccttatacaactagatagggacgcctgagggagtcctcgatatatcgc

SEQ ID NO: 5280 - DNA, 374 bp, Bacillus thuringiensis
gctgcttgctggatactatccccactatttgaagactctcttttttctggttctttcatatcatcctatcttgggggcattgaatggtctgtttcaggcatcgcaacaggttttaatcagggttggggcacgacgctgctggtgtctttataccccgttatataaacaagggcagtcgtaagcatgttcatcttctgttagcaaaccgccagcgcgaataatattcaccgtgtggcgagacagggtcacgacccatttcattagcctgtggcacgccatataattaacggcgaaacccgacctgagcgtgcactaatatcagccgccgactgtagaaaaagtttctcacgcttggatctggtggataatactac

SEQ ID NO: 5281 - DNA, 419 bp, Bacillus thuringiensis
ccgaagtataccagttttttcacttgtaatagcaaatagttatcgagattgtaccattaactaataaactggctgaaagatagtaagcctttgcctcctcaggagggccttctattacctcaaagcttctctagggctattcattgctactctcagcacgctacatatgagtatataaaatgaggtcattttcaatctataattcgtgacatcttataatattgtcatacatcaccatatgaagaagtgagaacacggtcttgacagttacacttcgaaattgccgtatcagtgtgacagtttacagggcggtattgatggaaaaggtgtcacttagctaacaattgcagagggcatatgaacataagttctacttccatgggcagggagtgattcgactatagatgcatacgaatggt

SEQ ID NO: 5282 - DNA, 300 bp, Bacillus thuringiensis
gacgcgtttcttggaggacccacacttcgtgatgaagcatgcggggctgttacctagtaacctatacccattttttcttaaactaaaagcaacccgtttaagggggccatacttgaaaaaaaactgacggtactcctctgctaaactgttaatcaatcccgcgtgagttgaattctatggccagaatgttgaggctctttcaatatatattccaatgatccgggagccctaatctaccaaccgcttatttaactgatatttcatctgacgactatgattgacgcacgttaactccaaatg

SEQ ID NO: 5283 - DNA, 177 bp, Bacillus thuringiensis
gcgtcaacacgcttttttttgcgaccaacgggacacgtgtcaagggggggtacggaacgggggattgggggacactcggaaacttaaaactcattgaaaacctcgctggtgaatcaaccgtattacatatcacccttttctctacacctaaaggaaaacctatggccacaaattcta

SEQ ID NO: 5284 - DNA, 417 bp, Bacillus thuringiensis
ggaggtttccagaacgtgaaaggtaacgcgattgggaaatacagtgtagcagaaaagaccgatgcagggggggacgaaagaagggcctgagtgggggacgtaaatagtgcagaggacaaagaagatacgaccgccgggccacacgtgtaccgcgcggggtgcataatgtgaaaaccaagtgggggactaaggagtagaactgaatgacggcaccgcagaagcgaacactggccgggaaacagaacataaaggatgttttcccagctggagaagtgagctgaaagaatgctcggcgatagtccgattgcgacatgagagagtagttgcgcactgcataacggacaccatgagctggatcaattatctgaggagcggaaaaccggctcacaacaatgcggtagtatagccctcgagaga

SEQ ID NO: 5285 - DNA, 260 bp, Bacillus thuringiensis
gcttgcagagggaaaatgctagctgaagcatgcggactttttattaatggcactgtactcagtctatccacacgtaagttatacattaaataacacggaagaacgtgaccgttctcactcggtattaaacgcatcacatggatcaattatacgcagtgaaattagcgatatctgttaatcacctgggaatgacctaccttataccacggaggatatatccctcatcattctacgcttttaccagctaaagtaaatagcgt

SEQ ID NO: 5286 - DNA, 425 bp, Bacillus thuringiensis
gtaaaacgatcctccttctgatgacctaacctacacacacactacagggcacagcccacagagccgcaggaccgctaggaggagctaatcttataacaccaggaccaggacggactgaccgctggagctccactacgtgaagcagggacctctagtgatcgcgattcagcatgcgggatgagaatacgatagcctgtccttgtacacacccgcctgacaaagcagaagagcatgtcgcaccgctaagacgatgccggaaccatgatgaagccaatcggctaaagggggacacatgattgcagggaaagctgaccaaggctaccatatcgaagagtgcgccaggtacaccgactcactgtggagaattgatgaacgctgatgaccaatataagttgccgagtatcgcacagatgacacacgacgag

SEQ ID NO: 5287 - DNA, 392 bp, Bacillus thuringiensis
tggtgtggtaccctcacagcgcctgcgcaacactctagtatgcataccgacgagatagactgtccagctgagcctgtttatcatggaaaccctacccatgagaatggatctctatacacgcacggcgggatgccagctacgactgcacctatgcttgcacttgcgaacaagtgtacaacggctattctgcacaaggagaacccactatgaatagctgcctactgttaacatgctcggattctttacatgctgtcacggataacctgcttattatctagtactatggtttcaccgaggatttgcttgagacagtgaccagattgtgacacctttggtgctggactatccttagccgacctggtaaatggataccttcagacctgtatacatac

SEQ ID NO: 5288 - DNA, 547 bp, Bacillus thuringiensis
tgatgcagcataggatgttcaagccattggaccttaatcctaaaattcaccttttgaccgcgtttaaaccctgggaccctcgtatgtggctcatgaaaaatcacgtggtactctttgtgcgtgacactaagactggagtgaataccagacgataagaaggaatgtgctgtctagacactcatcagatggattgacgatatcgcgtaggaccgagacgctgcacttacactgttactattcatacagtactctgtacgagcgccgcatcattgaaagcgcttgcagatacaggagctaaaacactctaactgtgatctataacaggactgtgggtgtggaaaacttacaaaaaactcttgttgttgcacatctagatccgtatggatagcccacaggactttctcgggtactgaatcatcatcacaatgctgctcaactaggagagccgcatacacatctcggaatgagtgaatcctgtgattaactaatggcactaagacctgtaagtgaaacatacgctccaagctataacctacgccattgcgta

SEQ ID NO: 5289 - DNA, 359 bp, Bacillus thuringiensis
cccctttaaatggaagggaactcatccgctttctccttttctgcaaagtaaaggagccccacatctagaggattgagtttcttgctggggctctattccgatattcggttacatacggggggctcacacgcgctattgcccttccttttagggtgacaggattcccaatataagagggccctgactttatatagggccgcttataaggatactgattgccaggtgtatactgaatgcctttaggattatcagataacagtcctgtccatctaaaagggctgcctacttcatgaagggaaagtccctggattcgttccatttggcgtccaatttctctcaccatatcacgcatatttgca

SEQ ID NO: 5290 - DNA, 212 bp, Bacillus thuringiensis
acgattactttggtggtgctgagtcaatcacacgacattttttaaacggctcattatttaatagctgtgaacgcgtggaaagacttgactacagtgaaccattccagttttccatagacgatgtccaatttggtgaggacggtgcgttaaacgcgtttcggctctctttttatgtatggtacaaatactgacgcctcaagatacgagagtta

SEQ ID NO: 5291 - DNA, 389 bp, Bacillus thuringiensis
cccaccattgcatgtttttccaacgtactcaaacgacaaaggctttgtggaagggtgctgaacaatggacgctatttaatgcactagcatccataatcatcggcgacaatgctattcgctctaaaggcgtgaatgagcgcaagatcatggccctcatctcaagcgatgcaaggctgagcggccctactagtctgaaccttgtatactgcgcactctgctggcttgaggcaactaacggcttgctcaggtatgccaaaattgacggccagccccgtactgtgactgtacaccactatcacagtccatactgcttgatcctatgatatattaccgaaggactgccttggatcacgacatgcgaagtactcgcctccgcgagcagccaatat

SEQ ID NO: 5292 - DNA, 384 bp, Bacillus thuringiensis
caagaattgggtaactgtcgactacaggtggggggatttctacaccatgccggtgtggaccatagctggcgccatgatggagtgactgttgcctcggcggtggtatccaaaggcaatggcggtaatactctgactgtaaactgtgagaacagcctggcattacatgacgacatcgccaggtggtatatctgcgttaagcttatgggtctttctttcggcagttgcgatgagaactataacagtatgctcggggcgatgatgtttgcgaaggtgattgcgttaacgtttcagaacgatgctggatacctgtacgtacaagcggaatttcgagtagcctattggcctttatatgattatgccgcaatatggtagtgtgctggtccg

SEQ ID NO: 5293 - DNA, 386 bp, Bacillus thuringiensis
gcgctactgccgtgctctccgctcgtcatccgaacttttttgataaacgcgtggccattatgtgacgggggccatactgctgtgacacggtaatatgcttctcaaccatgtacattgaacggtacattagctcatgttgaaggtaggacgacttctacactgatcgtctgcgaatatactccgtgatagatttggcaaccgtaccctatgtgtggtcttacgtaagcagttcactcctatctaccaatagcgagcaggctgcgctacgctctcacagactaaaccagatgctcggatgaatcacttgccgtgacatcctttacaaaagtagatgctccgctaccagatgggtccatagcgccgacttattcccgcacagacactag

SEQ ID NO: 5294 - DNA, 158 bp, Bacillus thuringiensis
  unsure (1)...(158): unsure at all n locations
cgcaactncacatcaaagagtaatacaacgtcgcagctgttgaacgcccaatgcgcatacctcctctcccctgacgtacaccgcatgtcacaaattgtggagccgacaccttacccatcacaatgctacactttaaccgacgaccaggacggacaggc

SEQ ID NO: 5295 - DNA, 399 bp, Bacillus thuringiensis
aatcggacaccacgctgattgacaactttgatacctagctattctaataagaaaagaattttttcacagaaataaaccgcacctgtcgtttgtctatattaacatgacttacacggagaagaagtataacgggcattctctttcatacatgatatcacgacttatataggcgtaaagggtagtgacgagaacagctgaactattgtcgtccaaaaacactcacaggatgaaggggatttcatgcattgtatctacagagcgttatttgtattcactccagctcattgttaatatctcgctagcattcttcatgctatttttcattggctgctcgcatcataacaaccgaatacgtggtctcgtatccaacttgactatctactgcaatctgacctagac

SEQ ID NO: 5296 - DNA, 358 bp, Bacillus thuringiensis
cggactgaatatgctccggacgtctaaacagggggaagttcatataaggataacagcccacgctctattagaatacacacaaagaaacgtagatccagactacgtatgcttatgttagggcccggactactctaacagggacttggcctgtgctaccatcggagctagctagctcccctttcatgtccggtttggggccagagaagacctctatgtccttaaggacacactctggaaggcatatgccttcgaaactacagaacagtcgcctcgtgctatatgggaaagagctcgaccaattacattttgtcggcttcataagaaaccatgctcctcccatgcacgtatctaccaggac

SEQ ID NO: 5297 - DNA, 365 bp, Bacillus thuringiensis
ggttgaatgacgctgatccgaagttacaaatactgaacactgctgtccgtcgtgaattagttgaacgaatgaccgctgggggatctaagcttagcctatggcttacatcggtgcttcgtcattgagacgaggagaggtaattgtaatcgcgtttcaagtttgcgcaatatggtgcgcagccacaccatcaccacttgacgcccgctgaatgaagcgcaccttggacataacgaggcgaaacggaaagcccgtcaatgataaatgcacagatatgtattacattcgcaccatgaattccttgacgtactctgccgtcgagatcacgtaatactcctaagatagaagcacgcgctaagactcaacat

SEQ ID NO: 5298 - DNA, 152 bp, Bacillus thuringiensis
tcaggtgggactcttattgtaaaagagcgccgcacccctattcgtggggtgttttatagacatataaatgtggatccgcccatgagacgagcatcctgataaacgactcctctagtatggagaggcgaagactctgaggactcttcattttc

SEQ ID NO: 5299 - DNA, 498 bp, Bacillus thuringiensis
ccccacaaaccccgggggcgatatttcacaacaaataattcaccaacaaactaatccagacaaccataatacaaatccacactccccttcaacaccaacctatcgaatttgaaaagaacaagaaaccctaaacctaattccacaaatatgtacacacaatcattgaagcatatcgacataaagaagaaagaaatcaacctacaaactaatacaacctatcacacccactatgcacagaggcaacattaaaaaccacaaaccactatgaaaagccagcaggaatggaaggggaaatataaagaccactacaaatataatgatgagactcatcataccaagaatggctggactaacaccaataggcagacccgcacaaccgactacaacccctcaaacaatacccacaaacgctccactaacagcagcaacgacccaacgaacaaaaaccatcactaaaacgtttaaaacatcccacactaaaaacagaaaccatcaaac

SEQ ID NO: 5300 - DNA, 353 bp, Bacillus thuringiensis
  unsure (1)...(353): unsure at all n locations
ttttggggggtgctaatactaaaaaanataatcatccatccgtttaaacaaatttttcaccatactcaaactatcatttccccattcaaagtaacaaaaaatcatccacacaacacgtcttacattgacaaccttcacttcttttaccacttttacccaattaaaaacaacatcactcaatcaatgtgtctaacacatgatttctcctactctcattccatccccacatccctcttcaattcatgtaaccattatcgactgcaccttggacatctccaatcactgttaacacatttacacatgctttacaatcatctgttaattcattccatatttgtacatacttcatccac

SEQ ID NO: 5301 - DNA, 376 bp, Bacillus thuringiensis
ctcttgttacgaatccaccatcgatagctccgcaacaggatgcttacactgaacaatcttatcatttttgcacgtcatcctcgcattactttcaccgatgaagcatatatcccatcacgtgaatcggctgtgcagttgaacatggtgatgcaataatattagacgtcaacatactacctgagaatatgaatgctggtcataagaaaccatctgcttgcatagaacacatattggccacctgtttccaattggtaccttaatggcctaggatacggacgtataagtaagcgtttacataacagatacggggatatacagaatcagcttcccttataaaaggatgaaacccataagctgctttttaagtacgaagcag

SEQ ID NO: 5302 - DNA, 380 bp, Bacillus thuringiensis
  unsure (1)...(380): unsure at all n locations
cccccccccccaaaaaaggggggnaanccatttacaaaacaaacaaaattttggatcgcctgacatattacgtagccgcacatcccaaggaggaacaacacccacaacgatgtacagaccgaaagaaactaaacaacttataaaagaggcaccaacggcaagaacgacacatgagaaacatccacaagaaaaagcagagacaacagaaaaaggcaccgtacttaaagacaaagaaacccaagcaaaaacgaaaagaaagccacaccgcaaagaaaagcgagaaaaacgcaccgcagaaaaaaaaacacaacgtgctccacaaataaataacacgctagaaacgggaacaaaaccaaatccaattccaaaacgcacaaaag

SEQ ID NO: 5303 - DNA, 208 bp, Bacillus thuringiensis
tattattctgtgactttaatgttctacacccaatgaaactttacaccagggggggggtcttttttattatgtcatagtcatacccaaataacgttacctgttgcaaatacgactacaacaataaactggtcaaaaattccgcgcccaaatgataattgtcatttgcttttaaggtctgctgatgtaacaaaccgccttacctggtcaa

SEQ ID NO: 5304 - DNA, 423 bp, Bacillus thuringiensis
  unsure (1)...(423): unsure at all n locations
caaaccttattttattangcctacccaatagttattcattatcaacaaagcactcttacattggatatttattgaaacaactcagtgctaaaactattgtccaccgtctacaactctaatatttaacttctaatacagagtatataaagaactcttatccacatattatcttacgaccacctcatgatacccctgcttaatttatacacatgcttgataaataatttaaaacacatgacatttgcaaacactttactgcggtctaacataaccgtgctcacgccttaacagaccgattcttcgcaacgacacgtaattcacccacaattgatacctcaaacgaattgaacaaaatgatctatccatcatgcctttttatcttaaagaagaatagcatgaacaaaaaaacttggaattccctca

SEQ ID NO: 5305 - DNA, 151 bp, Bacillus thuringiensis
ttcttctgtatcagtatagaacattgatatatcacctttattgttgctcgtacgaattaaactgccaatgccttgtcaaaaacttaaaatcatatacagtacatgttcgttccacaatagcagcttttattgtttacgcttcgcctcaaac

SEQ ID NO: 5306 - DNA, 211 bp, Bacillus thuringiensis
gacatacgtggatacatcaagaccgactgcactatgcgtgtttggcgagccctcctaagactgtgtcgtgcatcgggggcgctgcattcatttcggtttcggaccgtgtggtctttaccacttgaccaggctgaggaaattcatagagaatatgaagtatttaaccgtcaaattggagaaacaggagaaacatatggtcgttgaaaagaag

SEQ ID NO: 5307 - DNA, 365 bp, Bacillus thuringiensis
tttatctgaaatacactcttatcacaggtgcaaataccagaatcgggtacaaaacagcaataacactagcatcccacggcaaaaacttagaactcgtagctcgaagacaacaacaattagacggacaaaaaccgaaaataaacgaaacgcatccaaagttagacgtgagacattcgacgaacagatttaaccgacaccgaagatgcatataaactaaaaagaaagcctacaagcccatcaaaccgaaacgtgcaaaaataacgcaagaatagcaaaatacacctcaaacgcccaacaaaaattaaagaaaacccagacgaagtagcatgtcaatatagaaccactaacaatacccacttctcatt

SEQ ID NO: 5308 - DNA, 348 bp, Bacillus thuringiensis
caacgaaggggaattcggttattgttctgtatcgccatgaatccacgaaccgtgctttcttgtctacagatgatgggacacattaatcttgctattctgattaatatggagtggcgcgcttctatagatgccctatcaagatgccatcagcagggacgaactttgcgagcaagaatgcgctgcgctcgggacataccttacttatgaatgcgattaaatcctgggggcattgcgatacgcatggccgcacgcattgggcatcggagaggatgctactgcatgtacgattatcgttggatgtggactaggcatagtttttaaggaaacaagcagacttgggatttcaag

SEQ ID NO: 5309 - DNA, 355 bp, Bacillus thuringiensis
cgcgttcgcgatcacgtgtggtctccatctagccggggcatcagtttctttttctccctctcaaattatctgagtgcgagcgatgtccggttgcaatacggcacaacagacacgtgccaggtccctggcgcacaccactggtgtcctatgtgtggaacgtattgacatatagtgcgatgcgctgactgccaggtctgcccccttgtcgccttgttacgcctgatgacttatgaagctgagcaacccgacggtgcgaggcgcttcgtgcaatgagggctattcacccatctattttagggattcgaagagctagggcgcttatttcctgagtgcgccatcatttcctgtgaacgct

SEQ ID NO: 5310 - DNA, 192 bp, Bacillus thuringiensis
cacgtgttttatagaactaccacaggctgaagaggctagtccacaaccacaaagcctaaatgcgccctttctttaattaagcaccaaactagaccctggtaggggcgactatcgcaatagtttgccacaaggacaatcacggatcgaacgtgcactccagcttctttggattgtaaaccatatctcagggca

SEQ ID NO: 5311 - DNA, 108 bp, Bacillus thuringiensis
ggcgattatcactgttttcttgaactgggccataaactggctactggtggatgtaactgcgttggtgaacacccgttactacaatacactgttatgtcaaactaaacc

SEQ ID NO: 5312 - DNA, 464 bp, Bacillus thuringiensis
tcagcaagtgtgaactccatcccaaattccagtcaaattttgacacgtactctactgtatgtcttgtgaaggagactcactatttagtcccctcatttttctattaaggtctttaccacttcccattaccataccctctattaagtattttttttatttgaacccatttattcccataaagagggaattatcagtaaaggaaggcctatggtcgatattcctaaatcttgttttggaaaataaaaaaattaaccctcgcaagttagcttatcttaatttcttctacctacccctagcctggatcacttttttcattatttagctcatcctcatcatttttttcctgtttgcgacctcattaatctctgtactccctatcttccttcttatttttttaattccaacccaattacccgtttacactcaagtcccttttagaaatttaagctcacctaccttcaaaa

SEQ ID NO: 5313 - DNA, 272 bp, Bacillus thuringiensis
ggcgatgaaaggccactagttaaggtggggaaagcacataatgccttactttggacccggcttgataccgaaccaaacttcaattagctacatcaggtcaagatgcctacggctaaaaaggagtgaccatagcaggattgataatttagagactatatttatagacagacgtttgctatggctaaatcgcattgcaggtgttatagggacatggacgggtttaaaatgcgtgggactacttgcatctccgttagttgtgccctatttgcacc

SEQ ID NO: 5314 - DNA, 258 bp, Bacillus thuringiensis
  unsure (1)...(258): unsure at all n locations
tcacaatatctttcncttcaccaaattaatcaacttcaataacctttaacatctcatcctcactcaacttaaaaaatacatacgctatttacataaccaccaccccctataacattcacttcacatgaaccattcaacatactatactttacccaaatgacaatcctaatacaataacaccccatttaccatccacataattaactttcccctaatataccataacacccacaacaaaagcgatatttataattctac

SEQ ID NO: 5315 - DNA, 103 bp, Bacillus thuringiensis
ccgcaccctactacccccagcaaaacacgatccccatctgcttccctccacatgcttcccgagcctaacctccctctataccacactttttgtggccccttct

SEQ ID NO: 5316 - DNA, 275 bp, Bacillus thuringiensis
tttttgggctaatgctttctcatgcccaggattgaattttaaaaggcgctgtacctataacagttaggcggctaagctatcactttgcccctttacttctttaaaaccgttcagtaacggttgcccatcccccccaatttcaatcgaattcccccggggttttcctccaaccttccatccacccctttcccccaatgattcaaaccctattgggcctgctttccagactttttcttggcccggattctccattccagcgaattctgcaaattgtt

SEQ ID NO: 5317 - DNA, 445 bp, Bacillus thuringiensis
aaaaaaacaagtaacttactacaaaatataaatttatcaaataaccctaatccacaaccaccacacttacaaatatacggtcatcaaaaacccaaaaagtttttctactactcaaaaattaaaaagaaacaaccatggatatgaaaattaaacatacactgcaaaacttaaaagccaaaaaacactcatatatcaatctttttaaatcggaaaatacaaaaatagagaatgcatcatctgcattaaatcatatatttgatactctcctaactaatataacacaaaatatttcagcacaagcacttatcgaaacccaaaacacacaaattttgacatcacatgtaaaaacgttttaacgtctgaaaaacataaattctaaaatccagctgtacaagatagccgatttaaagataaatcatccttccttatactacaactaacatat

SEQ ID NO: 5318 - DNA, 291 bp, Bacillus thuringiensis
tctccaaccctctaaaaacaccttcccaaacatacaccaaaccaacttattaaacctataaaaggtacaccaaacacaaaattactcaacctaagactcactcaaatcttatctttagacaaacataaaacaacacattcatacaatacaccaggttacccaaaaaaataactcacaacaactcacaaccaaagtcaaaacttataaatatcacaacaaacacaaaatatcactaggacattcatcaacccttctgcactactcacattacgaaaacacactaatactcac

SEQ ID NO: 5319 - DNA, 159 bp, Bacillus thuringiensis
aaacaagaatatcaatattggatacaatccttttcaccttaataacatcctctataataaaccctcataaatgattacatccattacttcctcccttcactaaaaaaaaattataaaacctccccttttctataccaatttcttttaaaataatcattc

SEQ ID NO: 5320 - DNA, 269 bp, Bacillus thuringiensis
caatggcctaaaaaacaccacaaaacaaaaaccacatatcatatccgatcaatacctctaaacttaactctcagaacaactcaaacaccatactcataaactccacttcacccataactgaaccaacaccaacaatatcaacgtcgcatcatataaaatcacgaaatctcccatgcttaacacacccatctaaaaatactttcccaattacataaccctaaaaaagcaaaccgacgtacaggcccataaccacaactataacgaacaca

SEQ ID NO: 5321 - DNA, 261 bp, Bacillus thuringiensis
  unsure (1)...(261): unsure at all n locations
aactccccnnaaatccattaaatattaccttagctaaaacatttcaacaacacctcattaaaacgccctagaaaatcatcctcttcaacatacgccatcaatccaataaaatcgccaaactcacaaaaatctatacacgccatatcgaaatatcacaaacacctcattccaaaatgcacctgaatatccaacacgtaaaatccttccactgtccgtacactaacacacaccgccttctctatcttttatccctaaaccaaa

SEQ ID NO: 5322 - DNA, 104 bp, Bacillus thuringiensis
ccccgcgcgacaagaagcgtcgaccacaaaatccagatgggagaatccggttttagagaccggaatgattagctgaacataaataagaaaggtgaaaaggacca

SEQ ID NO: 5323 - DNA, 299 bp, Bacillus thuringiensis
aggtgaaagtctcgatccttaacgactgatctactggctcttttttttggcttaccaggggccctcttatttagcggctccatggttatccgccaatgtggcaaggctcacatacctctgcgcttagaacatggcggcgaaacgttgaagtagtgttaagataccatgcgcgagccagaggaagactcttccggcgcaattaaagccccaacgctgctgcctagctatacgacatgtagcacatgacgactctgttccaacatgcgttggcagaaatgtcgccgtatggaccgcaagac

SEQ ID NO: 5324 - DNA, 263 bp, Bacillus thuringiensis
aatacggaacgcactgcatcgtttcttggttgcacctataaggctagctgaactattcattggaaaagtgcttgggagcctaatcacacatgccatgtgcatattactcatcatgttatttagtaaatttggtgttcaggcgaattgcggcaaccatattgaaattatattattcatattatacccccacgcgttttgcatgctctgctgcgggttacgaatggtgtctctcacgtatacagctgaggcgtctagggcaatta

SEQ ID NO: 5325 - DNA, 376 bp, Bacillus thuringiensis
tcgcagaaaagaaaagcgaacggatccgctttttttacggacggagtgaagcgtggactatagtttaccgctggtcatgttgcaggtttacagcacatgcttactgcacctgttcctggcgtgaacgcggaatagggaagtgttgtcgacacataggagggtgctatatacgagggggcgttcaattagcagcgtacaaaacgtttcatttatcagaaacaagttgagctgccgcacccgctagtcggttaattggtgcaagacatggatgcgccgtcactgccggtgaatgtgctcattcaaactaaccagaattcatttgtagctgtaaccgacgatgaagttactcgtgagccggagctgtatggagataaag

SEQ ID NO: 5326 - DNA, 349 bp, Bacillus thuringiensis
gcgctcgaggctcgtgtacacaaacacatcacatctgattataatctatcttggcatcaatcgtgatacagtatccgggaatatgaagcactaatgctaacatatgagcttttgaaactagatttatattcacaagcagtagaggaacatttgcttcaataaggagtacaaaataaccaggaaagtactctgcttgcagagtgagtaaatgacctgttgtacatatagtttcatgaagatagtagtatcctaatggagggacacttggtttaaataaaggtggcctttccgttctgaaaaacaatgacggtcaattgaaatgcatcatgcaataaagagaagattttgg

SEQ ID NO: 5327 - DNA, 116 bp, Bacillus thuringiensis
ctttttcatatcaaattttgactaaaactaactttatcttaaagaagttaaatgctgcttaataggtaacacctgaaaaccgaaaaactcttctagcctcactggctcttgggaaa

SEQ ID NO: 5328 - DNA, 247 bp, Bacillus thuringiensis
gttatgaagtcaactttttatcaactactttgaccgcccgtttaagcaacacttgcattatacctagcaaatggctttagaaaatctgcattaccattaaccattacgatgggcctattcttcctacaaggcgcaataaatatggtattaataatgccagcaaaaggtgaaacgaagtttgtagtaatcatccattcggatttaagagcttccgatagtaccttaattactcaccggcggtatggaa

SEQ ID NO: 5329 - DNA, 325 bp, Bacillus thuringiensis
tctacttggactgttactgccgagggcgtgcagactttttgcggaccttccactcacgatgacattgccaataccgattccgttagctaactggcccatttgctgagatccagaatcgagcggcttactgccagatgcgactgacggtccatcagggagcgtatccgtatggattacttttggcgcagccacatttccggcggtatttagcgtcatagcttcatacaatgcatcgacagatgatgcgatcgttatctaaacagtgatgatactcacaatacgcccacacttaagatcagagcaaaccagattggtcgtattacta

SEQ ID NO: 5330 - DNA, 306 bp, Bacillus thuringiensis
aatgcagtcggacactaatccagcaataccgcatatttttttcttagccataaattcgatataggaacgaccggagtcatcagaacatctagggcggacgaaagctgatagatcacgctatggtcacactatgactgcatgcggcgaacatccatctataaacttttgcacatttgttgctatgaatcggaagaataatgcgaacgtcgcactctaagaatgtcaccgattgagaggcgcacgtgctacatcagctaagcttccatgatgggacagacggcacacattctgatgctgcggatggaa

SEQ ID NO: 5331 - DNA, 148 bp, Bacillus thuringiensis
atagctacagaccttggtggtcgtgagcatatagaagatgagaatgtggggataatcgatcgtcagacagacttatcgaatcctaattgggggagagaaaactttgaataaagacgtaatcctcatgcgttatatctttgattagaat

SEQ ID NO: 5332 - DNA, 278 bp, Bacillus thuringiensis
cttgaatcgcttcatctgctaacttaccaaatgcgttttttgctcgttgtacagcctctctagccgcggggcgtggcgttgtgggtattggacgctactgtccgcttagtccggcactgacaaagtcgcatacggctgatgagctgtggagagcgctatcatttcaccatcaggcgggcacatagtgatccatagaaccaggggtgcccgtttgaaagaacatgtgagcgaaaagcctgatgcgggacgggcaaccgcaactggccgagttgctggac

SEQ ID NO: 5333 - DNA, 394 bp, Bacillus thuringiensis
gatcacaccgtttgtcatacaataatagaaacagcttcatctccatggttctgttttacatattgcacataaaagtaaatcaagatacctcgtgatactcggtattaaatgttgtgctaaattgtaatcggctgatatctcactattccatttctgacagcatctactcaatcttctggaacattcctgatgctggtatactatatctcacgagcaagtctatcggtatagcttcaggaaaaacgagttcattgtatgctggtgtttttacctagctcctcgataccccctgaatttatgcgtcaataaataaatcgaatcctaatttcaaacctgctaactacgatacttaaacggtgtctattcgataaccaattgtggcttgtagcaaaaa

SEQ ID NO: 5334 - DNA, 292 bp, Bacillus thuringiensis
ctcctatccttgtgtgtgccttcattgcacaaacgatttataggtggtacaggattatcaacctgccgaacatagtctacgtctgtcggcctaggctaaggtcctgactaaccatgagcggacgagccttactaaggaaacctgtaggctatgggtggacgggattcatagccgcatttcgactctcataccggaatgctcactcgctaaactctacaaccagaccttacgagtgcgacttctattaaggacagagcgctcctctaccagtgataccattatggcatgaatc

SEQ ID NO: 5335 - DNA, 106 bp, Bacillus thuringiensis
cgcgagatccataaggcgtttcatctaatagatgttccattacttctatctcgcctgacaaactatataaattatgggggacctcgcacgtccaagcatgaatctc

SEQ ID NO: 5336 - DNA, 135 bp, Bacillus thuringiensis
acaaatggatcccattcacgctcctcatttatggcgtgcgccaaaatacccacattccgaccattccaggtagacggcctatcaccgccgctaacggaacacttaccgtagtttatcatgtatgcggcctctgct

SEQ ID NO: 5337 - DNA, 157 bp, Bacillus thuringiensis
cttcactgtgagctaggctagagtactctagcaagaggaagagcatgaatacagaccatacgggagtgacccgtattacctagtctggggcaggctgccttcctgcgtttggtctgacataaacactggtggctgtcactgacgcgcgagctcactt

SEQ ID NO: 5338 - DNA, 367 bp, Bacillus thuringiensis
agagctcaccacggcgcaagaggctcgtgtacaatttcagatagctaaataccgcctttgttgaaacaggcataaaaaactggctgcaaaagcggttaagcaagaatccaatttgagacggcagtgccctgatgaataacaaccgcttcggacggtctagcggcatgtgctattcaaacaccaatagactacgctattctgtgcctaaaaatttgaatatatgcggggagcctattaactgtagttggctacatttcaaaaacatcacgttctgactagattcatttggctgcgaagatcaacccgctcgtcgactacgaagttgggtacgaatgtaattacgcctccaagatgttttatccataaa

SEQ ID NO: 5339 - DNA, 402 bp, Bacillus thuringiensis
gtatcgaacctatcgttattggtacaagcgttcatgcgagcatcttatgacgggcctatatcaccaacagcatggcattcggcaggggctgagagtaacccaaaatgctaccggaaagcatcatttacatacgcacctcacgcagcccgctgacccatactgaaaggagtgcgtttagcagggcaaatagggccaacggcagagtcacagctcaccatagccacctattcactagccaccaggtgcctagccctccgttgcaacagcacacgtgcgataaacaataccggcaaacctgatcgctgcatagacggcaatgcataaaccggagattccactatttgcgcactcgatgtcatcataatgaacagccgaatcaatgagacatccttctaccataac

SEQ ID NO: 5340 - DNA, 300 bp, Bacillus thuringiensis
cacctttgcgatcgttatatgacgtattagatgcgtcggtttttaaatacagctgcagccgatgatccggtgagcctggtttgataaccattgttcatgaccgcctgttcattacgaagttggtggtagtggctaggacatagatggagtagccatattaactattaccgacacagaaggccggcatcttcgatacgaaaaggaccggatacgcatgattaacaatttgtacacatatgcatgagtaggtacagtgggcatggggctcttcggacttgatgagcgcccagctgctgcagc

SEQ ID NO: 5341 - DNA, 410 bp, Bacillus thuringiensis
cggatggtaccggctaattgtatactggagatgaccaaggttgtacgaaaggagaacgatgcacagcatatgatttatcgcgcaatgctaggtaaaatagaaataatccgttcctttacaaatacctaacttcttagagggagttccttgctaagagtttacgcgtacaccctatttctaacatacacgctactctgtctaacgatcattgaaaatgcatagacctaaagttagctactcatgccctgtccgccttagatgagcataagtattaattgaattggtataacgttggtttgttctcttgcccagtgaaccacttctatatcgataattagcatcgcctcagaagtagaatggttaattagaaaatatgtgtgatgagcacactattttttgatgctcaaatc

SEQ ID NO: 5342 - DNA, 363 bp, Bacillus thuringiensis
cgttaactggcatgttgttattgtggaatatcactgtcatgatacaggtacaacattcgatttgggggatgtactaagtcgaattacaccaattgtgaactcgcataatatctcgcctgttctaattcattttgcccaaggtgagagctctcacattcttactaacgtgagattttataagccgcttcacatagctcattactcctggtgcttacaacactgggaatgccttgggtttccaggtgtagatgttctaaagccatgtcacctgatagcttatatcctactactgattcttgatgctcttgcatgggtctctattttacgtgacttataaactcatcctgatgttaagccagtata

SEQ ID NO: 5343 - DNA, 383 bp, Bacillus thuringiensis
gagcatacgaaagagctcatttgattctgcagccttaacgacagcagtacgggttatacttcgacgcgtctgcttattgctatcgtaccgcctgtttgcacctgcaacgcttattacttttgacacttcactatccattggcgatggttggtgaccaccattacaaaggtcgagacgatggtcttgcttcatgcgtgaaaatgcagcatcccgtggaagatcgttgagatagccgaactacaactgatcgacaatctcttcaatgcgacaaagcgcttacgcacgcggtacttcatgatcaacgattcttaagcgctcgttcgcgagttttagcgtttcttcctaaagaaaattgaaatcttcagctgcaatttcttgttcca

SEQ ID NO: 5344 - DNA, 112 bp, Bacillus thuringiensis
accattatgcgtgagctctttcatgttctcagagatacagcaagaagggatatcgtaaaggtgacaaatgatacaccaatatttcgaactcatggtggttaaacgaacttac

SEQ ID NO: 5345 - DNA, 301 bp, Bacillus thuringiensis
ctctacactatcgacttcttcatctttatctggtgtaaaagaaagagcatgatcttcatatgcattgcgaaccggtgcatgtattccggcctaatttatcggttatactaattgacgtatcccttcacttcgtactgcattgatatcaaaacatgtcaccgcctgccctactttcgcctgacctacttccgctctcattccaccctataccttacctcctatcgccattatcattatctcttgacacaggaacgtacattatgaacgatctgacatatatatctctagcggagcttgctcc

SEQ ID NO: 5346 - DNA, 242 bp, Bacillus thuringiensis
aataaaagaatctggctcttccggagatgccgaaagcatgtatacaaagacgatgcactcgcactcagtgagtacatagcggaactagactccgcggactaaaaaagagaagcgcgatgactgcaccgatagaagcgtgcgatgcaccacctttaagcacagagacccggtatgtccttttgcaaataaccggttcgaagcactcgctcctgaataggcaccctaagtaatcacaagttact

SEQ ID NO: 5347 - DNA, 162 bp, Bacillus thuringiensis
cgttttagatgaggtttttgacttggttaaaacatcattcgtagtgggggttttatgaccgcaagctgtgactgtaacacttgacattgtactgagaatgataatgggggcaagaatggatgttattgcatgcgttggtgcttccttggctgatgaagatgc

SEQ ID NO: 5348 - DNA, 276 bp, Bacillus thuringiensis
ctggcgcaacatgtatcagaacttaactgattgaaacgaattttctacctcaagtggacggtagaaaaacgcagcgtgattaatcgtcccaaacccagaatgtgacttataccatacatcctctaggggatgatcaggtggtgcagcaactagaagacctgaaaagcgcttctatattaacagcaccatcatttgctgtatctggaccaacaccaacttgtactgtatcaaagtttgaaacacctataacgccttgaactatacttagacgggcca

SEQ ID NO: 5349 - DNA, 165 bp, Bacillus thuringiensis
acaaggtacgttcttttcatcgaatattgggccctcggttgcttcttattatgcctttctaatacagtgggcaattgcgcggttagagtagactgaaggaactgccgcatacgctaaaaacgcgtcactggcaggaccgcacctcgatcccatttatgacccctt

SEQ ID NO: 5350 - DNA, 212 bp, Bacillus thuringiensis
ctgaaccgaagctgtattcacttgtgggcataaaaagtaaacgagggggccaggaacaagatcgccaccgttttttggcatgagccgtagattctgagcgtggtcccacgacataaagtaaaagaattgcaaatagacgattgaaagttaactaccacatacaaagattgccaagctgtataataaaatttgggcatagcggcagatcattc

SEQ ID NO: 5351 - DNA, 325 bp, Bacillus thuringiensis
tccgttgcacctatatcaccacaggagctatcagcgatgttttacgaacaatcccacgctactattgcatcgagggtgcatgcactccttcctatacatgcactgcgtaatcatttggctcaaacggactaccgatgttgcccgacaatcggtgcgatcacatcactgcgctttagttcatacacttcagaaatcctagttacatgctcacgatctcttggtctcacaattcctttgcccattgaatagcacgatatatagagtatccactaacaccgtgaaatacgttataatggaccaaatcttctgctttcgatggaacaac

SEQ ID NO: 5352 - DNA, 253 bp, Bacillus thuringiensis
gaaggcatgatgtacgagcatatacttgccacaggcactattactgtcacttttgcccacttatctatgaatagtttctaaacaagacctgcttgacaactcgtatccacatgccatgatgtagatgctaacgctgtctaaaatcgcatttgtggatgtgtatgatttaattcaactgtcccatttctattgcgatgcttttgaattatattactgaatacaggtggtatgctacacgcttgctgtaagcatg

SEQ ID NO: 5353 - DNA, 297 bp, Bacillus thuringiensis
cagcttccagacattttttctgcactgattgagtaccaaacggcagtgactgtctttctaatccacgcaaatgcatgagtcgcaattgttacgcaaccattccaacgagtcaagctgaagcttgctagtgcatgccactccgctgaaggttcatcgctagtgcatgtgcattgggaatgtgctgactctgacctcctctcagaagatgaggtgttacattatctatatgtcgaccgcattgtttgtgagtattgtgtcatacaactccctacggattgactcactgtggtaatgccg

SEQ ID NO: 5354 - DNA, 226 bp, Bacillus thuringiensis
ccattcctgacaactgagcacgatgaatggctagtggttgtagagtgtgataaaatatcgccggaagaggcgattaatggcggtaaaactaatggacttgacgatcacgaagccttagacggagatagccctcattggtcagaagaataggccgcgattggggagagagatgccccagtgggtaacaagactccgcctttaaagaacgcggactctgacgtggatg

SEQ ID NO: 5355 - DNA, 196 bp, Bacillus thuringiensis
atcgttactaaaaatgtttgagcatccagcatctaccctacaagagatgggcgagagatgtcaagtatatgatgtagtcatgaatgagtacgatacactaaagaatatacacaggaggagactgatgctgtgactctaattatgtatatcactaactccactctctggatcgatcataaagagaataatacgagcg

SEQ ID NO: 5356 - DNA, 397 bp, Bacillus thuringiensis
ttgaatatcgacaccatgattctaggcattagcaaacgctttaaatacagaaagtgcattcggatcaatcccaacaagagctggcagagtcattggcatcacgactatcgaacttggtatgctcactcactgacatacagccgtatcagaaagctactcatggcgagcttagaccatataatgtatgcgaaacaaatagtgtggaggacaggtctgtcaacgcgtgtcaagggtggcgatcatacgctttaccgtttataatcgggagactcgaattttggcaggcgctaatacatggtggggagagaatgaacgaagagggctcctgcccttttactgtgataatacggtcacagatcacagaacgctatcccatgcactcatagggctattgcta

SEQ ID NO: 5357 - DNA, 217 bp, Bacillus thuringiensis
gtatggcagttgaaagtttgacacagatctggagaccgcactacagtggtgccactaactgatgacactgcactatccaaagtccactgacgcatcgtatatgctcttctaaccggtggaaccgatctatatggaggaccaacagtcgccgagttagatgcacattccattgaatctactggaaatcacgacgctaaggatacgatgctcggattga

SEQ ID NO: 5358 - DNA, 164 bp, Bacillus thuringiensis
ctgacgctcgaacgaattaaaactcgcgttaagggtttttatactcactaagataccggctactctagctcgaagtattgcacgaagatgcgccctgcccacatgctgtccaacatgacatacacttattggacgcgtttcatgtgaaagggtcatttcatttg

SEQ ID NO: 5359 - DNA, 165 bp, Bacillus thuringiensis
ctgactctcgacgctgttgtattacacaagcagaggaagaaaatgcgggagcaaattatttataccgctgcactgtccattcaatagcctaacctgaagcataaagagtgaagtccgacgacccttaatgaggaactaaccgcaccgattattttattaccttac

SEQ ID NO: 5360 - DNA, 297 bp, Bacillus thuringiensis
tgctatcgcctaattcttgcttgtactgaagttcggtcgaaatatgggggcacgatgaagcctgcaatggcttaaaacccgagctccatgcatatagcgcccattaataattgcaacgacacataacgaaattggtggaaagagaatcccgaatgacagcatctttcattaactttatgccaaaccccgcttatgaaatagggtgaattgtctgatactagagctactggacgcatgcttactattaacgttcctctactaaagtatctcgcaatatactaattgtatgttattccc

SEQ ID NO: 5361 - DNA, 252 bp, Bacillus thuringiensis
ccaaatccccttaataaatgttttttgcccggggggggaaccgttttacaccagggtctcttttaggcactctcccggataaacggggggctaagggactgaccaatgcacaatagataatgagttcattaatgggcggtttaccggtacttcccggagggtggtggcaccacaggaaggatttagttaaaaattgggtgaccttggcccaaaaccggaaagggggcaaaaattccgggaaaattctaaaag

SEQ ID NO: 5362 - DNA, 264 bp, Bacillus thuringiensis
gtatggagtacgtgtttttacatgacacatgcgctgcgaaattccgggaacagactggtggagagaaacgcatatacccacattaacagggattgctacgatataatgaacgtgactgctacgtctgtacgggccattacgcggactcctgagtgctatggttgcctatgtcgagcccatggactggcaacaaccagcgaccgtatgtacggatcatgtaaaaagcggattcacgaaagatccattcgcatgcccttgtttgtg

SEQ ID NO: 5363 - DNA, 360 bp, Bacillus thuringiensis
tagcttactacgggatgtttgagcgagctgtaaagcgttatgccgaatgatcaaagcgaataagagtctcccgattaggagcgagagcggctagctgagaccactttcacgattgatcgaagtggaaggccgcccttcgcggattcaatggaatatatgaaagtagggtacatgcaatagcgatcatgacttgagacttggaggcgctaggcactcagataggcttatgatgcacttgtagcgctgaagaggcaaacttatcctatgcagtagccaccagtatcaatttactgagtgagcgatcaatacgcaactggcagcagcattatgccgctacatgaaaaacccggatatggcgga

SEQ ID NO: 5364 - DNA, 127 bp, Bacillus thuringiensis
caaaaagataagacgacgagttattcacgaatcaacagcgggaaactcctcgacattacgataaaaacctacctaaagcattatacacttggaagagaaataccataaacgaaagacgtgcattgaa

SEQ ID NO: 5365 - DNA, 127 bp, Bacillus thuringiensis
acaacaaaaacgtcgtcaaaacggtgttttaaatattttttttcgctattgtattactattagtacctgtggtctcttatcaatagcctgctactagtacgaacgaccaagctttcggtacagaatt

SEQ ID NO: 5366 - DNA, 148 bp, Bacillus thuringiensis
gtatttccaactttactgatacagctctattctgatccactactggggggagtttcttcttaatgatacccgcggaactctcattggtgggcctatacggccaaagtcctttctctttaatcctatgcttcggggcgccgaaactatt

SEQ ID NO: 5367 - DNA, 119 bp, Bacillus thuringiensis
tgaaacgattattgaattgtgcataatgcaactaacctttttttgaaaccgggatgttcaaatgcggaaaggtctaatgcccttggaaattctcacgattaatcaaatcccaagggata

SEQ ID NO: 5368 - DNA, 126 bp, Bacillus thuringiensis
tacctgaactatagcatatatagccttaaaatcatctatattaaaccttggcgcataaaacagtcacattgaagtgtttaagcacggcgaattgaacggctggatcttatgacaatataatcattt

SEQ ID NO: 5369 - DNA, 515 bp, Bacillus thuringiensis
ccccggggtgttagacctgccctgggctcgaaaggctggcccccaattccaatttttcaaaaatggattttttttaaaatggaggatccacctttcccgtggggggaaccttttttttagggaaaaaatttaaatttccccgccgttttggcctggcttccccttttgaggaatagggcccaaaaaaatgggtttaaaaatgggccccgtgtcgttaatccggggaaaccgtttttgtggccggtaaaaatgcttttttttacccttagagggggaaaggacccagggcctcatgcaaattattttagggtggggccttttttttttttttaaagagggatagggggaggggtccccaaattggttggtttattgggggcaaaaatgagggaggcctttttttttcattaagggagagattcaggggaccaggtatatgaaaaatttttcgggggcgcaggcttttttataaaataggcttggccccatcgtttttttggtttaaaaagggggtt

SEQ ID NO: 5370 - DNA, 229 bp, Bacillus thuringiensis
gggcagattgcttacgacaacgaacggaggatcagatcgtatttaacacgtgaaagccacatctagtggagtatcatgcgacatacttgaagattcgtttgtgcaaccgtagatatgatagcctagaacgctagcacactgaatatactccgtataaaacgctcatgatggggcgctttgatgatgtcatggcggcgaattaaatagtgtgaaggaccgctcatcttaa

SEQ ID NO: 5371 - DNA, 155 bp, Bacillus thuringiensis
cagaagggcatgttgctatacttagggaatggtaatatttctagcccaattcaaaaattataataagggatgattttagatccagacgacgtagtgagtgtgcccctctttttactgggatgaagacagattaagaagtttatgtatcatagaca

SEQ ID NO: 5372 - DNA, 420 bp, Bacillus thuringiensis
gcttatcaaaaaggttttttgcacgctataaaccactccatctatgtatcttaccacccaggaaatgcaaaaactgtgcctgcacatgtatctaccactagtgatgttaacaccttgcagaggtaccatccatccgatgaaaatatgtaactcctacctatggacaagcctatttaaccggcgtttaagctatttttggtccaaatatcgctatatcactcgctacatatgcacacatcattgctctgactattatctctggcacttgagcaagtaatgctacttgaaacttatacctcgaatggacattctgagctcgaagctatagtgcttatacaacatcgatcatctacatatgatgacacggctggggcatatctttcaaagatatacttcggtaacaaacacactgtcagaaat

SEQ ID NO: 5373 - DNA, 549 bp, Bacillus thuringiensis
gcatctgtagcaggggaacaggaggcaatgtaaatagttgaatgtactgtgtgagagccaaccactttgcagtaatacacaagtaatgggatggtaccaatacagtattatatgcaagtgtgagtgcactagtattgaataaagagagatggaattaatcagacggaggatcagcgtggggcatcagccataactctggtaattgtcagatggaagctgtagatcgatatctatctacatagaagagaccatgatgataatgcacggagcggaagaaatcgcgaatatgctacacggctacatatacaaatacgttacagtatgctgagtgaatgagggaccaaatggcatgcattctgcggacgaggcatcacgaactccgtatataaacgactttggaaacaacagtctcctaaggtatggcatcgccaacatattgggacagtgcactaacgagctttgttgctactaatagagcagaatgaaaatgagtgaaatctataatgataacgcagttgctgactagagcgggtgacaatagagcaccgc

SEQ ID NO: 5374 - DNA, 253 bp, Bacillus thuringiensis
cgctagcttgcgtggaatcagaaggcgatgtaccggattgtttagaatgtgcgagagcgtcccccctggtgggaagagctaaggccatttccgtgcaatcaaattatgttaacgtataggtcatggcatagtgtcctgagggtgcgaattcgtgagatatcagctttgcctgtaacgtgaatgttaatggctatgtgagctagggaatcattgaatcaacatcagggagctctaccaatcgtacgctagaatc

SEQ ID NO: 5375 - DNA, 121 bp, Bacillus thuringiensis
cgcatacacactcctcctgggaaaagcacctgatggtgataacatggaagattttgcatgcgctctcacaaacactgcaacctgtccaaaaattttgcatttaatatgaagttagacaact

SEQ ID NO: 5376 - DNA, 386 bp, Bacillus thuringiensis
ctcattttactaactgtcaaagcgagtagcatgaatccttatgttgagcggcatggcgagtagcttcttaaatcctcaaatcaatcatagaatatattaaaccatctccaataactggaaactaatcttaacgcttttattagctgtcacactcccacctattactgaagtgagtattaatcgaccttgtcctagtgatagtgatagctcacttactctaactgaagctatgcaataactcattccacttcatgcttatgaaaagcataaagggattaaccaagcgtgcttaatgatgagagcatctcacatgaattgatttgctacttcactgcatcctatctctacattgaaacatcgccacgccacatgactttactatgaaa

SEQ ID NO: 5377 - DNA, 275 bp, Bacillus thuringiensis
catgggcgcgtaattttatcgacgcttttgacgttagcggcaagaaacgattaatccgtgtcttttgctaatgtgtatatcctccttcgaatatgcaaaaacctggtatcatcagttaagctgcctctgattgaagactatcaatcagtttgaggtattgccggaacgatttataaccatttcgcgaaaagggtttgcaatatcaatacataggagtgttagaatgggagtactgatatagctggtaaatcatctatatcctccattatcaactt

SEQ ID NO: 5378 - DNA, 133 bp, Bacillus thuringiensis
tgaatatgccaatttttcactgcgtgggttcggaactcgaataacttgagtagcagcaattggaaaacgcgttcactatgactgcacattagtttagtctcattgcaggcgcaaccgatgaatttgcctggac

SEQ ID NO: 5379 - DNA, 339 bp, Bacillus thuringiensis
acagcgcttaatgatatttttctcgatgcggcctcatatagtgaggggtactccatgacttgttatggattcattccaataacaagctctattagcgcatgatgcataatcggtgattgtgcttcaagccgcctgcatgcttcgtctcatactcattcttggcgcgaataatattgcggtgcgcgtgccctaagcctggcattagttagcgtgccatggactgtttcccacggactagcacctggtttgattgatggtcttgagattgcataccatatgcgtcttggttgggtactggtagctgctgtacacattgaaccctgtgtattggcttttacg

SEQ ID NO: 5380 - DNA, 112 bp, Bacillus thuringiensis
cactatcataagccatgtctaatgtagaatcgttgatcatcaatagatagggtcaactccgattcataacgtgaattttcataaatagatacattggtgcgattatgcattt

SEQ ID NO: 5381 - DNA, 166 bp, Bacillus thuringiensis
cttcacagctcgatttttcaaatgcaatcattgatcttaaagaggcggagctgaaagcgatgcattgcgaggcacatcatctattaacaccatcttcccttattgaataacatgcctctggacgcacagagcgtcaatagatctctagagtctactctaatcgccg

SEQ ID NO: 5382 - DNA, 111 bp, Bacillus thuringiensis
caagtgaaatatacatgtttatatggacgctcatgcatgcatctataggatggacaacagatacctaaaactgctgagttccagaactggtgcggtgggactctttgtgtg

SEQ ID NO: 5383 - DNA, 213 bp, Bacillus thuringiensis
ctccttgctcagacgcccgcgaatattagaatgcaattgaatattttttttcatactacgaccccaatcagctcggtgcaaatcgaacatatacagacacgcttaattgataagacacgcccattaatgattgaatgattaaatgcttctgcagttaataaacgagcggcgtatttcgattcttttacctagtacccatgacaagtgtactgg

SEQ ID NO: 5384 - DNA, 135 bp, Bacillus thuringiensis
ttgggattatacaaaagggctattagcagggcatgaagatatatcgatgacgtatgaggtaggtaaagagaacgcagcgatgtcaacgactgttacattaaaaaaaaatgctcgtgaaaaagtcatgaatactgg

SEQ ID NO: 5385 - DNA, 230 bp, Bacillus thuringiensis
taagaacttagcatattttaaacatgctgctagggttccatcatgactacggaatcgggtaccgaactgaatggaccatttcactaagtatgctagtccatatagctctactgtgaaccaagccacaccgggcacagtggagagtgctcctgatggagagtgatagacagcctgcaactgtgagcctacaaatagtaagagcccatttacgggtgatggtgtgccttttg

SEQ ID NO: 5386 - DNA, 128 bp, Bacillus thuringiensis
tacaaaaacacatagtcccaatcagacatatttgctatcagcgggcattgtaataaactcggtgaagtacgaggttggagtggagaatgacggataaaccggaactggaacagcgatttgaattgctt

SEQ ID NO: 5387 - DNA, 179 bp, Bacillus thuringiensis
tcaacatactcataataagaaactaccatcttttttgaatgtatcctgagtaccgcggaacacgccttactaggcaatattctgggaggaccatctcccaaggcttgatacttcctattgatctattgtgatcaattccctggagggaaaggagaaaaacgccccggatggggagtgaa

SEQ ID NO: 5388 - DNA, 143 bp, Bacillus thuringiensis
atgaactgcatggctcttttttcaaaggcggcttaagctgtcacctatggagggacccccatcccattaacgagttggtgaggtaacagctcaccaaggccaccatgcgtatcccgcctgatagggtgatcggccacactggg

SEQ ID NO: 5389 - DNA, 227 bp, Bacillus thuringiensis
ctcctcgtacgccccgtttcatgtgagagcgttggaaaaccataaccttgatgaattcccactaggccacgcaacgttctcatgcgatattgaatgggggaagtctccttactggacccccgttcccgcatctttcactggcacccataattttctatggcgcacactcatgtccctagcttatactcataactggtgataccgtacaccgactggcctaacgggct

SEQ ID NO: 5390 - DNA, 128 bp, Bacillus thuringiensis
acctattttacggtattagcgttaatatgaaaacttgctatttctgcattagctaaagcacccatcgccttgagtacattaggagcactatatctaaaaatttcatacccactaattactacaagtaa

SEQ ID NO: 5391 - DNA, 148 bp, Bacillus thuringiensis
ccgtacggcactatttctcttacttgcttgacgatatatttctgctgagcgttgactaaacagtcatcttgatctcctattaaatgacgtctatttaaccgtcactgttactgaattcggagggagtctttgttaggtgacttaccaa

SEQ ID NO: 5392 - DNA, 298 bp, Bacillus thuringiensis
ccttcgtgtaggccggatcatacgactgtaccatatctctatttggtaaatgtggcgactacataaaagcaggggtaaaaggtgtgtcacaacggtcaattagatagagagattcatgaggccgaacctgcacgacatcaccttgtctaattggaactctttctttattgacatcgaagcctattgcaccttctaatgccttaaagaccttgtcgcacgtcgtatgataacggttttgaaactcctgccccggtttgattgactacaatgcctagatcagtatctggaccttgtatta

SEQ ID NO: 5393 - DNA, 275 bp, Bacillus thuringiensis
ctgcagacgctcgtgtctggatcccgaatacgcgatataaaattgtcggtcacaacgggtcaggatccatctcaattttgtatcgaagaggacatctataacgcttaaatggaaaatcatcattcgtgcatgtactatatgcagcagctgctggaagcgacgtcactaacgagaccacattgttgcaccgcttctgcgatcattgtatggagttagctcataccgaaaattctattaacgcataaatgctgcgcgcgtaacaaaacaccgagggc

SEQ ID NO: 5394 - DNA, 122 bp, Bacillus thuringiensis
ctatcgatcagattcggatcctcgtaatgatggatcccccgctaaaccctccccattttatgcaaatcattaccccctaaatactggggctcattaccttacacctcacgtaacatccctaa

SEQ ID NO: 5395 - DNA, 125 bp, Bacillus thuringiensis
atctgcagcctccctgttttatgattgagccgctgtcaacaggagcgtggattcaattcacatactcctttcaatgcactcactatactatggcggggcattaaactccgaaacgcgtgaacgcg

SEQ ID NO: 5396 - DNA, 238 bp, Bacillus thuringiensis
tcgatccgaattcgtgatccatcaccacgcccgtccatccatccttgtattcgatcatgatttatactatcctcctgatgatgctgccagcattcatattaactgaaccactccacttatcttccaatccacagcctaaggcttttggacacgaaagcttattgctgttaacctattcagatcctcatccctcgatatatgcccgggaccggtggctacaccaagggcgttttttcca

SEQ ID NO: 5397 - DNA, 127 bp, Bacillus thuringiensis
aataatgcatacaatcgtatttgaccagccgaacacatttgaaaataagtgggcacatgtatataaacgtgtgaacgtacataaccaaaactgaaaccactattcgattgattcaccagctttttcc

SEQ ID NO: 5398 - DNA, 350 bp, Bacillus thuringiensis
  unsure (1)...(350): unsure at all n locations
ggtgcagcagaggcatcngaacgtgaaagtacacatcgcaccataggtgggccgtactacgcggcgcacaagtgctattaactgcaggtagaccaggggcatcagaatggcaaactttttcaaagcgaaccaacttttttagagcctaaaaatccttttggctatccggcaacgggtaccaaataaataattgtggagcttgaaaggagatttttaaggaagcattaaacgccagagggggagccaccttcgtaaattaaatatgaatttttcaattctttaattggtgttttatattgcccaataaaggaattggttttttggcaaattaaaccttaccctggtttttt

SEQ ID NO: 5399 - DNA, 308 bp, Bacillus thuringiensis
gcactgattgacgtgtttcctcacacaactctacctattacaggccggggggaagctctttactgaataaagaaaccgatcttcgttggcttatcaataatcggtggtgcatagctaatggctggatcaggcaaagcagcatcgaccctatatgcatcaccgttttcagtgcggtactgcgtgcatgcccaaatggagccccgacgtaccgcgtatgcggccgatattacatctatcctagaacggacccatgcgatggcagacgtgtctgatgttacacatgctggagccactaatgggcctggata

SEQ ID NO: 5400 - DNA, 360 bp, Bacillus thuringiensis
tgagaattggtagaaatttcgataacaatcacagacgactgatacgggctgatcgcacttcatacagtcaaatggatgctagccacgtgaacaaccaattacttattccgtgtgtggtctacatagctcttgaatatcatgaaacgtgtttcctgtacttaccattggcataaaactatctgcatctacttcaattccgtacacgcatccatcgatgaatatagattgaaatccattggcgctggaccggcaaggtgtattgatatcacatatatagtgctgacttcaaatgtatagcagtatgaaagccgctcacgtgcataaatttaagcttgaaagaaactaatcaagggccatgcc

SEQ ID NO: 5401 - DNA, 245 bp, Bacillus thuringiensis
gcctgcatctcgttcttagacaccgacgtatcaatgtgttttttaattaccatcggggacctagtatgaagatggcgtattgaagcaagtaccccggtttgaccacccccacgagccatcatcgccaaaaccttctggtaaggcaccgcatcatctcatttctaataaagaaacgctaacgctggcaggagctttagaaaagctaggtgtcaaacggaccatatactaagggaacttggacacag

SEQ ID NO: 5402 - DNA, 256 bp, Bacillus thuringiensis
ccgattcaagggctctttacctattactatgctgattatgtctcatgtggatacgaggctgatatacgctgcgacactatatcatacacacacatggctggggacatttacatactatgcagaatattcaccatggcacagacttgtatcatccatcctgttcacattcataatgaacactctccgcgcgaatactgagaatgtggtgatgtcataaacattacgtacgcgcttgctacagccatcctatgctacg

SEQ ID NO: 5403 - DNA, 425 bp, Bacillus thuringiensis
tgaaatatataatgtaacacagacatatagctaccgtctctatacacacataatcccgctaccataggtgtcgattttttgcataaacagctttaaaaacggggtcatgtttgtgcgctgtaccagcccgctcggattaaggctctacacgaatgtgaagaacctcgcttggatatatgcgcacctgtgcgctacaatggtgcagattgggacacagaggcatgaatgcctgcgttagcgacaagtttaggatggacagacagcgcggagagtatactcaaatccactcatcataatggctcataaaatgggcccgcaccacccattgcactgatatgatgtaccgagataagtaaaaaggggctcaactgccgttcacgcggtgtggatcgatcttcgttctatcggatttgcaccatcatcat

SEQ ID NO: 5404 - DNA, 362 bp, Bacillus thuringiensis
ctatatttaacctctgcggttcctatatcggaaggaatgattgcatgatcatacgtaccttgattaatgacacgaatactactggaaatacattttatgataatagcgtacttaccttcaatactgccatgactgctttctgtgtcaatcacaccattgtaaccatcatcacctatatgacgcggtggctttagaatattgaagttcactttccaaaacttcaaatctgaaactgatatctgctgctactggcggaacatcttgcgcactgcctgatacttatctgtatgtgagctgctgtgacatatgacactgactatatcagggcatcttgctacagctctctgcatcatctgttactg

SEQ ID NO: 5405 - DNA, 494 bp, Bacillus thuringiensis
gagtgtacgcgtctgatccttctaataagggggaactatccagactgcgtgacttatgcttatgctattgatggcattcgcactattctaacggattcttgaagagcatgcaaaagatatgattctcaagcatagctcaagagggggatgagggactgggacgatttaatggtcatacctgtgagctgcacgaaagagtggaacgctcacaataatcatacagcagactatactctaaagaatcaaatgatccaccagcggatactaatgagggcgctgacggagctcataaagggttatgcacactgaggtgttccaagcgatgaaatcttattaggcagccgcattaacggacggggctggaaacgttgtgaggcagatagtgactggcaagctcttccttgttaaccatgactggatgggagacttgcgtctaaaggttcttgggaggagtactataccgcttacacaggggtatatggtaaccgccataa

SEQ ID NO: 5406 - DNA, 219 bp, Bacillus thuringiensis
ttatatgtttagttttttttcaccaattagatgcttaaaatgttcctgggcattcatgctacggagtgagggatggaccaatggaggaagcctcgatactagaagaattctctttaaaagaagcgatgactactatttatacgcccgggacgaccgggaaaccaaaaggcgtaattttaacatatggaaaaaactgggcccgcgcggttggctcttcgc

SEQ ID NO: 5407 - DNA, 260 bp, Bacillus thuringiensis
taacttgtgattcattatttttattttaacaacttgtatttttctatgtacatattcttgatgcctttagagcattatgttacctttatcgatagtaaagggattatttactttttgtaatctaattgttgcgtaagatttcttttataaacctatttgttattatctgtattccgattcaacaataactaatcatgcctgtagaaatatagaatgcaattgtaatcgtataatcgggaacagaaatatataaagaatta

SEQ ID NO: 5408 - DNA, 338 bp, Bacillus thuringiensis
tatttcaaagataactccgctcttctccctagccctcttttttttttgtaaagacgcaggccccataccgtgcagatttaatatttccttctcactatatttcgagagtccttctacagtttgactaccatggagttcttaattgccctacatgctggcgctgcatgaagagcagagaacaccttctttcggttgtctctcttcttcacagactgggcacgatggtcaatcgctacttttacagaactcgtgtccctgttcacacgttctaaacccctcttcccgctaccatatttaagcccctccattcttcaatactaactacgtgattcccatca

SEQ ID NO: 5409 - DNA, 381 bp, Bacillus thuringiensis
cgctgggctcacgtgtggagtgtaggagtggtaactaagcgccctacacccataaaaccggtcgagactgataataatggctccataactaacagagcttggtagagccaattgaccttgcattatgacggcgtggacaatggaagagctgcctatatccgactgcgatactattacatgagacagaacgcactaagctgtacgcgtatagatcagtatgcactatggaccaggttgactatgtagaggatgcacatgaacagggggcacttcgtcttttactaatagaacgtagaccggaccaggatatccaggttgttcttgatgctgtagtagcagcttactatgaagccatgctgcatcacggaggaagaaagccta

SEQ ID NO: 5410 - DNA, 484 bp, Bacillus thuringiensis
  unsure (1)...(484): unsure at all n locations
gcttgtacgaccgaattcacgattaatagacagctgtgtggattatcagcttctttagacttgagggggngaagtttgatgtataatagtatattgcataacaggactgattaaactgcaattgcagcttttattaggatataatctgataacttcctttctctaattaataatagctacgcgccgagaggatctctgttcagaaacctttgtaatcgccacaatatgaagtccaatatgatgctggacgcgtattacgtaaaacgtttaggcactagcatgcaaccaagtttaccgtgcatgtatctgtttattggctaataaaacattattaacaggggaactcttggcttattcacatctcaaaatcatgcgtccctgtttatagatcgttatcgtcctaacagactacctcgcaacaatctgggtctaatggagatcatcatttactccgtctcatatcgttaatgcgcaatactcactt

SEQ ID NO: 5411 - DNA, 314 bp, Bacillus thuringiensis
ggcaaaaccaattgccttacttgatacccaggggaaggtgcctccggaaaaaggcttctattaagggaaacccgggcaacatttttctcctacttttccccaagcggggggggtccccaataccgccctatgggacggaaacaatatcctcctatcaagaatggatttggaaagacataccgcttgaaataaaaaatgggccctttgtgggcgtaccgatatatccatcaagggaaaaacccccgctttaaggggcggttttttttccaaattttgcctaaaacttaaaaaaagcgtttgtgaaatggccctat

SEQ ID NO: 5412 - DNA, 195 bp, Bacillus thuringiensis
tcttgctaacgacaccttaatcaggagtgcaacaccatattcatgaaaacataacgcgtccataacatacgttatgaaataaacggcggctactgctgacatatttggcgaggcagacggacttcatattgccaatatgcgtccatacccatacagaatgaaaatgcctgcatgatgcgataaagccggcctaaa

SEQ ID NO: 5413 - DNA, 166 bp, Bacillus thuringiensis
cccgtgcgtgggggcccacacgggtgggggttgcgctcaaggctgacatttttttcagcctctattacatgggccttatcttacatcgatttgactttgacatactgtgggatatcagaccttccttgtgagtgagcatctggaagaattcctttaggcgccagat

SEQ ID NO: 5414 - DNA, 136 bp, Bacillus thuringiensis
tctaaagaggggggaggctccaattaatgtggacttggcatcgcttcactggcatgggcgaccattaaaggtgccaaaatttggcccccggtaatattatagggatcccgggcccagcgattcaaaaatgaaacct

SEQ ID NO: 5415 - DNA, 255 bp, Bacillus thuringiensis
gctagccctagcccagatgcacggctcgaaaccaattcagagatacaaatcttttattttctacgatgctcttgtgcagcatgcatggtgcctagctttccctatttcgaggccgagaaaagcttgccgtatccatagacacggctgttaactgtcacagattggaatgctctcacaagaccacacaacatgaccaaccacaagcataaggtgtaagatgtgtggagcctaatgaaagatctcccccacattaat

SEQ ID NO: 5416 - DNA, 364 bp, Bacillus thuringiensis
gacatacatgttgtacatatgaatgtggcggtgctgaatgctttttcactatggtattgcagacccttcttgaacccaacaatttgatatgatgtgaaaaaggataaaattagcggtgttcttcattggactatacgcttgaaatggtgcagaagcacatctgctagaccgcacagagttttgctggcagtgttaaaccgtgcactggaccaattactcctgtagcttgaacgtgaacactgagtggttcatgttcttactttgagggcacagacggatgctaattgggttcactatgatgaccgagattatgaaacagccacttatactgaggtgtatgagccatcactgctgatggatcgtg

SEQ ID NO: 5417 - DNA, 262 bp, Bacillus thuringiensis
tgcccgctgtatcattggggcaaaagacgtacatgatatatagcttggtaatagcttgagctgattgacactttccgcaatgcttggaccagtctgactccggaatgtctgtacagatgattctacctatactgtcggacctgctgtgatattgactttaccagccttcaggagatatacagcagctgctgacaactcctaataccatcgttacagcgatgagaggtattcattcacattcgcactgcgtccatcactctat

SEQ ID NO: 5418 - DNA, 194 bp, Bacillus thuringiensis
ctgcttgatgcggtttatgagaaaccttgaactgaaaagtgagggtgcatggcaaggagatatgggtccgactgcatctggagctcatactatgcgaacgaatattgttttccatttgaagataatgcggggagcaagcaaggggcatgtactctaattccatttttagctcctagctttgcaacctgtgaact

SEQ ID NO: 5419 - DNA, 121 bp, Bacillus thuringiensis
tttcatatataatttgtgagggatttaatcctgtatcggctgcagcgttcgcgaaagaagaccggattatttaacttcgttgtcgagtgtaaccgggaataaaaaatgggctgtatgttaa

SEQ ID NO: 5420 - DNA, 391 bp, Bacillus thuringiensis
cggcgtatcatgaatggggccgcggtgcacgggactgacttgctacaccatttgacgataccatgtttatggcgggtgtacaggctggagcgcagctcgtaccagatgatgagttcaacgcatactattttactgctgactcatgcgcctcgcgagtcactcctcgagctgacggataacgtctggtaagcctcttgggggaccagaggagcatcgccactacagtgggataccacaatgaggatcgaatgacatctacaccaccatgtagacctgagtgcttatggctgagcgagggatatgcactgtcactgtgcgttaccaagagctatctactacacgatcaagatacgccgtccattcttgataacgatggataggatgcggagga

SEQ ID NO: 5421 - DNA, 363 bp, Bacillus thuringiensis
gatgtagaggtgttgttctaatcaactcaactatcagaatcacctgaggatgcgctgagacaagggtggccttctttgccataaattggagtgatagagcatcgtttgacgtgtatatcattggctgaacattatgatgctggcagcgctgaagcgtatttcaagcaacatacaacaagtggtgcgaactgaacgactagatagcaagacctgacgactcgcattgagatagatcggattgggatcaggagcttagactacagggtggcatgcggtgatcaactggatgatgggtgaacttataatgatcggtgagcatgatcaaaagatgatttgggctgcttatgccatcgtaaagaccgt

SEQ ID NO: 5422 - DNA, 480 bp, Bacillus thuringiensis
cgtgtacagatgtaaattttacgtggcgaacaatcagctcctcatgcggattaacaaagcacaccggatcattatgtgccagatatagtagatatcgacataggaaatttttatttatgcacggatacgcatgtagatgatcaaaggcggcatactgatcctaatgaacggggaagcacattgttaaacatagttcgaggccatatgctcgattgaatatgggcgaaccattgagaggcgaaggggcttgatggaaaatgcagtcagcgcaatgaatatgcatcatcctttggaaagtaaccgcaattgtcatcattggtcggcatatgcttaccctcccatagcggaagtggctaattggacagattcactatcgggcaagtgaagctttctgcaccagtcgaatgcactacaatgttgaaggggtctgtgggcattggtagagctatttatactatttgagctggatattcccacgat

SEQ ID NO: 5423 - DNA, 425 bp, Bacillus thuringiensis
tttcaagatgtcactagcgccaggcaggcccagagtctctgagttgatactccgatcattccgcacacatggataccctgacccaggtatgacacacatggcttgatgagggctagcatttaaagcatatctacatgagtcattctctatcgcatgacagaggatcgtctcctgggacggaatagtatacagctctattccaccagtgaagagccgatgacagtatagagcagagttcaccctgcacggggatcccatattgacctatacgctggtggggttcctggtctcttgcacttactccgcgctggcgatcggctcacatgatgtcgatggaatcgctactatggatacatcggtgacgcactatcaaacatgaacaagtatactgccaggtgtatggaaaactcattgtcttatatata

SEQ ID NO: 5424 - DNA, 170 bp, Bacillus thuringiensis
ccacgaccagatactaatgtatggggcggtgcgacgttaaattcagagtcatctttaagaccaaactctgagtctgtgactagaaatacagctgcgtctggcagggcaacaccaataacgaagccagggcaggtcatgatggctccttccatgatgactctcaggaatat

SEQ ID NO: 5425 - DNA, 126 bp, Bacillus thuringiensis
gctcatattaagagactatcttatggttgctggaacacattccatacggaggtccacaggagcctgttgcatcaagtaccttgcaaggggtctttttctgtgggagtcagctccataacctatgca

SEQ ID NO: 5426 - DNA, 148 bp, Bacillus thuringiensis
tatttcttgagggctttcaatctatgtggaatgttggagttcttttatcgtttattgtctaatatacaaggccgtaatgattggggctacaggcttagacttactaaatagttgcaggtgtttaagagtccttgacatacctatgtct

SEQ ID NO: 5427 - DNA, 249 bp, Bacillus thuringiensis
gattaaataaatatgtgtagcaaaagcactgaacgaattttttttcatagatagaacaagtgtgaacattggggcaacattaaaactcttccctccttgcttaatagtatccaccttacttcctcctatatacttgctatccgcttgccccaatttccaagccactttctttttcaaagatatttccaccaccagtctataattctcatcaacaaaattgacacactcaattcttaagcccagcaatat

SEQ ID NO: 5428 - DNA, 107 bp, Bacillus thuringiensis
tacaagaagacgcatatcagcctattagctcggagttttctagctttgtcctatcggaatctagatcaggatggacagtcatcgcaacactcgcaggatgcgtcaga

SEQ ID NO: 5429 - DNA, 294 bp, Bacillus thuringiensis
ccgcttccttatttttgaggggcgccagcgttgtctgactgggatcgcgcgaatttacgtctccaatcgttctatgcactcgactgaagggtttaatacgacccgtgtgtgcggccataggtgaaagcgttccctgtaaagaaccatcgagtttattccgcggcagagacactacaggtacggcagctacgtgcaccattttgtacggcaagtaacgcggcatggggtacacgcgatacgtgctgcatgccgatgggtgcgattacgctcggtacgctggactgcccggtcgtg

SEQ ID NO: 5430 - DNA, 224 bp, Bacillus thuringiensis
gaaatactttaccgagcgcccctatcagttggtcccattttgttttctaaaatagaatgcttcacaccgtgttctggttgataaggaacgtgctatatctcctttaacagaaggctcgtgtttgtcatttggtacccttgctccacatgacacacggatagatcccctgctaccggacggccatgataagactgctcatcgacatcctgtaacgcagaaacccc

SEQ ID NO: 5431 - DNA, 206 bp, Bacillus thuringiensis
ggagctatatagcggcacacagtatttatgatcatgcttttctttcaaggatgagactgaaactcgctaaccagggtgtaatattaatcgccctgaatatatcttcgatcctgaccctgctttatcaccatctttgcttggaacaacagacctaacgtttcaacgctgacgatcggcctgttcttaaatgaaagccgatccacatg

SEQ ID NO: 5432 - DNA, 222 bp, Bacillus thuringiensis
agagtgcgagtggtgctgtatacggactcggtttaagagatatgtgggaatacgccttgacgagacatgcatttgacatataagagcttgcagcagacagctcttctttttatgcattatggtacaggatgttgcgttgagcttgctaaaatggtttaccgttgatgactgcctacgttatcttttgccgcatgagctgctgctctcactctatgttattta

SEQ ID NO: 5433 - DNA, 223 bp, Bacillus thuringiensis
cagggagacgaagtgcaacgatacgtgaatctactgcatttatctatagaaagcctttgtaccgagatagatactggcgctaactctggagggacagctgacattaccacatcaagcggttgcaaatgcagcacccgttcttcacgaaatacaaatgaaatcacacctactaagggggtatgctctttatgagggcaaatatgaaacgtgtcttacattttaa

SEQ ID NO: 5434 - DNA, 445 bp, Bacillus thuringiensis
aacgaatgagaggggaacaggattaatatttaaattatatgtactcgcaatagcacgagctttttctactgcttggtgcagagcttgaatgagagcttgctcataatatttatttggatgagatactcggaaacgtaaaccttttgctacatttgcgccatttgaaacggctatatcatatacttccccagctttttgtacatttaaaacggtaatttcatacaaatgctccacgcggtatccttgtagcaatgctttatcatttacatattcgtattgaggagtaattgtataagaaatcgtgtctatatctttatcggcaataccaagctgtttaagtgcatccagcaattgtttggattgcactgcattttcttcttgagcctgttttacatttttatcatctgttcgaatgccaagcgttaatataacaacattcggtttt

SEQ ID NO: 5435 - DNA, 156 bp, Bacillus thuringiensis
tttttttcggcccttacatctcgctccatttggggtttacaagtgctacttgggcagtaccttggattaaaaggctcttgtgaataatagcttttgaacagaggggagattaagagagcaccatgtatttaattgattttaattagatgaaattat

SEQ ID NO: 5436 - DNA, 141 bp, Bacillus thuringiensis
ggtacgaagtggaccttttggggctttcagtgatgagaaatttaccggagatccaccgcttgctctgcgtgatgaagcgccactaacacaccgtcaaccggaagtaacgtctcctggtgagcggttggaatatgctgctga

SEQ ID NO: 5437 - DNA, 468 bp, Bacillus thuringiensis
gtatccaaattacactggtttcaaatccatccagtgcgtttactccaaatgcaaatactcctgagtcatgtactttacttgcaccgcaagtaaactatggaccaagtgtattagaaaacgctgaatctccagttggatccgaaaacgaaagggtcatggagttatgtatacacaacgagagcccgaagagtatatgaaagtctggatctcacttgcagaacatgctagctggtatggttgacttggtgtatctggttgagaatgaagaatggtatcttttaatcgtccaccaggatgtatcccgtgctagctaccactaattctgttacctatgaagcgacggatgagctcatgcctgtgtcatatctaacggctcaatatcaggtagacaccacagaatatttctatgttcttggagagtcaactgctgcgtgggaaatggcgctattgaaacatcctggttgatta

SEQ ID NO: 5438 - DNA, 227 bp, Bacillus thuringiensis
tgtacaaatccaaacttgtccctcataacgctgcgcttgtatttaagtgtgcatcactaccttgccacctgctgataattcttccatcgcaccgtgtgctggccgacatgcttcaatgtattttcgtccaataaactctacttggttctacggtccaacgtctgcaaagggaccttacatatagtgcaggcaaacctgaactatatctctaggctgaccaaggaagt

SEQ ID NO: 5439 - DNA, 176 bp, Bacillus thuringiensis
caccaactacccgcttttcatgtcagaaataatggggatgggacgatgccccaatgtagaggtgccactcgtttgcgacgtctttattcatgaccataatctcacctttggccatttaccgcacggtattataaacgatgactgtgttttcatagatgtgagaatcatacgtgagg

SEQ ID NO: 5440 - DNA, 194 bp, Bacillus thuringiensis
gatccgaatcatacagcttctggtgttcaaaatagtgcggatgaaacatacacctactgatcacgttacgatagttacggtcgtcttgattctgatacataagctcacctatggccatttaccgaactgttttataaacgagtactgtcttttcattgacctgatcaacatccagaaagatcgtaagcatattg

SEQ ID NO: 5441 - DNA, 181 bp, Bacillus thuringiensis
cgatgctcaagatgctcgacgactacttacagatgagtgtgacccctttttttgcgatgcgatccgtagattccgagcggggtgtacatgaaccaccggtatctttaatcctacgctaataatcgtcaatcgggttcaatcgtcgtgttggtccgataaagaacgcatataccctaccaaa

SEQ ID NO: 5442 - DNA, 198 bp, Bacillus thuringiensis
ctcgaggcactcatagtatgtgccatcttgattgactcgctcttgtatcctcgtacactgaccactgtcataggacttacgcttctgtggaatggtgttggattctttcaaaaccgatcatgcctctcttggtcttccacaacatgatgatagagctgaataacggcagcactggattgccaattatcagctgggtca

SEQ ID NO: 5443 - DNA, 361 bp, Bacillus thuringiensis
cgagatggacttctgatggtacttgtctcaaaccggctcttgtctccctttgcactgacgaatgaaatcaaccatacgactcagttgattgatcacgtgagaactaataatcaaaccgagtacagtcggaccgacactaaaaccgacaagtaacttaccaagtacagaaggctgacgcatatcttacactggtgccacgagctaatgaatgacacggcaaatgacgacatgaatccgattgagaatgacatagcatttgctcctactaaatctctaattagcgggtcaccaacccacggacatatatgcatggcgtctaccctagtgatcggcattgtatttgaaagatctacattcgaca

SEQ ID NO: 5444 - DNA, 393 bp, Bacillus thuringiensis
gtattgttttagaccttctctaacttcagttggatcaaaacccagtccactaacgacaactatggaatcactatagtcgtaactttgcagattatgatctatctcaaagttatggtagagatgactcatattgcttcatagcgcccgcggctactttatgtgcgaaagataggatcgctacttgatagcaggggccctggatgaccagattgactatatcgtccacgggaatcaacggagtctgcctgattaatcttagttcgatcacggcctgattcatgcggtgcatctaatttccgatcagggcctttggcaattttgagagagatcgttacttggacgggcattttacctagatcctcgctcacttgcgggggataatctaggtgatgt

SEQ ID NO: 5445 - DNA, 256 bp, Bacillus thuringiensis
atcacggattacactttttgctcacttatgaaacatcccttaccgagaaaatgcaactattaaagaacacgacgttcatgaccttaggagcgattttgcttgaagtgacataagctatagcttgctctatagcaggttcttctaatgcggaaggtcctttttttgcgaacttcaacaataaaaatacctctgcgactataagtaaagtgtgcaattaaattcaactaattaattgagtaaccatatcttccgggac

SEQ ID NO: 5446 - DNA, 276 bp, Bacillus thuringiensis
agaacaagaatgcgaagacattttttccgaggtttacaagaggttgaacatcagcaggggatcagactatcgaagtccgaccgccctgactatattctacacggttaccacgaccgattagggggacgcacggcagcaatggagtttccagaaaaagtcatgtatcaccgagccgatgagagaacatcttataaaaggtgaatagtagcttctatgacggggtagtctttgctgcaagcacgcacggataatctgacagggcaactttctaatatg

SEQ ID NO: 5447 - DNA, 170 bp, Bacillus thuringiensis
aaattttttaacaacattggtcagacattcatcccactctggcaaactaccagagcctacggggagaacaccgggattcccataatgataattaccagcacgctcaaaacgtatcagagatgcccttactcccagtatattattgttcattactggaaatatagaccatt

SEQ ID NO: 5448 - DNA, 208 bp, Bacillus thuringiensis
  unsure (1)...(208): unsure at all n locations
ccacacagtgtaggcctaggagctagacctaggtctgcgagaagacttgtacgacgagatatcagaataaaacagtttatacgtaatctttatgnntagcaaaatccccctaagacaagaggatagcttaggccccttgactattatgagcaaattgggaaattgatttcatttacttaccatgcctcccatatgtgcgcctatgata

SEQ ID NO: 5449 - DNA, 480 bp, Bacillus thuringiensis
atgaagatgaaaagctttgaccaacattttaagcaagtagcgcggtgcaagctaccgcagtggcattccactcaattgcatacgaactacgcacaaagatatgtaatactacttactgtttctccacgatggtttgcttcatgcagcagcgtaggaacgactcagagtgcactacgctcggtctgctctgcagcgtaaactggtgtcaacagcgtggcgtatcctactagggttaaaagaatgggccacccatttgatagagtcagctggggtaggctccacactgtcagagttggtgaagacctaatccgttgacgagaggcgcaggccatgcgcaacaggtggatatttctgagcaccagggccctcttctgctcactggacggacgcacactgtttgaagaagcatgcgattgtatgtacacgtactatctactctgctgatgtgcaggtggatactattaccgcgcatgctgatct

SEQ ID NO: 5450 - DNA, 226 bp, Bacillus thuringiensis
ggtcatgcgacgcaccgagcttggcctatagggagccgcaagacgagctcggcgtaactctgggcatagctgaccgctgtgcgcaaaagcaaggcattacccatgacacaccacgtgcgcaccaggcccataaagggccaagaccggggagccggccgagtgagcggactcacatcataggctccgcgctcacggccagcattacaaacaggaaacctgacgtgcc

SEQ ID NO: 5451 - DNA, 218 bp, Bacillus thuringiensis
ccaaatttgcctaagatggggttttttattccgattcccacggacccccatgggcgaattgattaagggctgaatgcccaaaaaaggtcacagcctttactaacgcagggggttcctcgggtggccacaatgacaatccgggcaaaaccacggaggtctctggaccataatgaaccatattcaaagggaaacccaaaatttagacaaaaccccccctt

SEQ ID NO: 5452 - DNA, 118 bp, Bacillus thuringiensis
cctgtgactgtgttcggtttacctgctgtcatatatgaactttattaactagactattgctaccagggcattacacaggttgctaatcaaatgactaaaggcgatttccatatgctaa

SEQ ID NO: 5453 - DNA, 420 bp, Bacillus thuringiensis
tctagaacctattcaattgtctacctttcttgcacgaactacattcttaacttcgaaaagtcgtcctgcggctcattcgcacatagccatggtaaatgaaacgcactttcatatagctgtgagtactcctattgttggtatttctgctatatggttctttctcacttgaaaactttaagctcgaacagttcaaattgcagcgccggatactgctgcaagatacgcgacacaaactcgcgctcgtctacctactccattgccaaatgcagctctgctatctcctggaattggagcggtcaatacgcggcgtgttaccacacttaaagattccttatatgctggttcttctacctgcggagcctgtctagattcatcctgttgtgcggaatcgtaatctaacacaacctgccctgcttcttc

SEQ ID NO: 5454 - DNA, 417 bp, Bacillus thuringiensis
  unsure (1)...(417): unsure at all n locations
gggtcccccacacgtgtaggnnctaggatctagacctgagcgtcgaacagaatgacgacgaattgaaataacccttttggacagtttctagaaggcctgaacaggggggagcgcgacgaataaggaagggcccaagaaaaaaccacacgacatgacttgcaccaatgcacggaaggacggagcaaaaacaagatcgatccaaaaatacatatcgtggatgacaagagggcaattttagctacacgattcgatgaaaaaagtgggtgaagcatcaatattatatgaaaagtaagatgaaaaaagagtaagcacgaagtatgcaaatagacataggaacacaaaagataaggggaaaatcgtttaaaatgcgtaggataatatggacaatcatgaggctaaaagggtttgatatgaaca

SEQ ID NO: 5455 - DNA, 318 bp, Bacillus thuringiensis
acgctattcaagcatgattatagccatatctgggcacgcttgactatgactttctgtcagctaactaaagatgttcactacataaccacttggccacattcacactacaccacccaacgtcatctgacattgtccaacaacgcgccagcagcaagcgcacctagcacaccatctgtatcaccagctgccgggagagcctgcagtacataatataacagtcaagaagcagtacgacttaaacgtatcagcgtccaacgaacccacgaaattaactcagctggaactagtgaaaaacaactcgcgatgccactcatgaac

SEQ ID NO: 5456 - DNA, 184 bp, Bacillus thuringiensis
ctccatcacaggcacttgtacattgtttacatgacacgaatcatctgatgtataacctagtctgacagcaaagtaagccgcatctgcctcagctttaaacttcatctcatgacactcccgcttatacactgaatattgctttgatcctaatgcactgattccttgatgagcactcagaatacct

SEQ ID NO: 5457 - DNA, 200 bp, Bacillus thuringiensis
caaataaaaaatgaaggataccccacatctatggggaacccttcttctctctatatctaaccctaaaagccctctctgtgcatattatcatttcttcttgctgacagcacataagcgcattctaaaccacgcggaagaacacactggctgtcatgcccatgaatatatgacaccatatggagcctctctccgacaagagc

SEQ ID NO: 5458 - DNA, 489 bp, Bacillus thuringiensis
  unsure (1)...(489): unsure at all n locations
caacaagaagacaaacaacaacacaactcatacgcccaaacaacccaacacaaaaaaaaaccacccaaaaacaccaccccacacaacgccaacaacacaaaacaccccccaacaaacaccccaaaaaaacccaaaaaaaccacaagcgccaaaccccaccaaacccccagaaatagccaccaacacaccacaactaaaaaaaaaaccacacccacaaaaaaaaggcccgacgagaaacacccaaaaaaancccaaaaaaaaaaccccccaacccccgaacaggaaaaaaaaaaccacccagcaaaaaaaacccaaaaaccccccaacaaacccccccaaaaaaaaacaccacccacaaaataaccaaacacacaccccaaaaaaaccaaaaaccacaagaaaaccccccaaaacaaccaaacgcccaacaaaaaaacaccagcagcgaaaaaaaacaaaaaaacaaccgaaacaccccccagaacaaac

SEQ ID NO: 5459 - DNA, 238 bp, Bacillus thuringiensis
atgatcgtcatctacatttctataactgattgcaaagataactgcaagaagccatgtccatgaataaataccagcgggggcagacctaagctaccgagctggtaacgagcttcatcgtgcgctgcccgagctccaacgcaacatagtacgtaatcaggtgcctctatatgatattctcgcactactagtggatgaagcggcccatgtataaagttatttgtgttagaagtcagtaaag

SEQ ID NO: 5460 - DNA, 451 bp, Bacillus thuringiensis
  unsure (1)...(451): unsure at all n locations
tcagaactcgtgatgaacagttacatgaagcccaaacgttggcgaaagaaaagcatgaatggtatgagtggaattataaaaaataagagnggggggcttttctatacatacactccaatcttcacaataacctgaagggaactcatgtgtaccaaaagatgaagcgtcgatgcaatcagacactcagtatatcatggcttatggctcggggacaccacctacgtcaatacgcttgtcgaagggagcgttctaaatcggctactttatcgctagagtacacctaaatgcctaatcctgcaaaaggccttgaatcacaagggaagcgatcctgccatgtatatagaatgtcccttagaaaaccatgaagtcacaaagttagaacgctcactttaacgtttaatgcctctaaactagttaacagggaaatggccaactacttgagaccttttga

SEQ ID NO: 5461 - DNA, 155 bp, Bacillus thuringiensis
  unsure (1)...(155): unsure at all n locations
gaaaaaaaaaaaaaaaaagnngggggagaaaaaaggggaaaaacggcggggaaacacaaaacagcagggaaaaaaggagaaaaacaaaagaggcccacaaatgaagagcaaaacaacaaaccaccaccaagaagagcgacgggaaacccaccaaa

SEQ ID NO: 5462 - DNA, 116 bp, Bacillus thuringiensis
  unsure (1)...(116): unsure at all n locations
tccggcgggaaaggccaacgaacgtgccgagaaaggaagggatgnaaagcaaagggagccggcacccagggcgcgggcaagagaccggnaaccaaacccgtaaccaccacaccacg

SEQ ID NO: 5463 - DNA, 206 bp, Bacillus thuringiensis
gaaaaacgatgtaactgatgatgaacggactttaatatttgtggtgcttacctgagctatggataatggagggccagggaatcaacagggaaattgcgtcgccactcctagacgctcactgatctacggcacaccatgttccttttctatcacatcaaatgagtgctcatatgcccatatccatagcatccattttcatccggact

SEQ ID NO: 5464 - DNA, 368 bp, Bacillus thuringiensis
gatttgccatggattgcacatggacttctaacatactaatactttttctattatcgggcgcttcgataacgccggcggtggtgcctagggtcacactagtggttcatacgttacttcttatgtccctatctatcgatgctgcgctaacaccgacaacatagccttggctaaaggatatgtagtgtatacgacacttcttctattccatctcataactgggtagctaacgccagaacattagctcttgcagacgatgctgccttcgacttggctgacactgtgtctactcaccgacacacgatatatacctgctctttgctgattcgctaacatcgccagtttgctaagcagctgctgatgccgaagac

SEQ ID NO: 5465 - DNA, 191 bp, Bacillus thuringiensis
  unsure (1)...(191): unsure at all n locations
aacgaggngaaaanggaaacaaangggggggggcgaggggagaaaaagaggggacccccccagacacacgggcaaccaagncaccaggacaaaacggaccaacaagacaaccaacggcacccacacgcaagccacccacccgagaccacgcaacaccccgggcggccaaaaacanaaccggcacaaccgac

SEQ ID NO: 5466 - DNA, 134 bp, Bacillus thuringiensis
  unsure (1)...(134): unsure at all n locations
cgcagcaagcgagggacccagcaccccccccaaagagaaccnaacaaaagccccgacgcaaacaaggccaaagcngacccccgagagaaaaagcaaaccgcccacaaaagcacacaacaaaccaaccggaagca

SEQ ID NO: 5467 - DNA, 202 bp, Bacillus thuringiensis
  unsure (1)...(202): unsure at all n locations
cgtatcagcccactctaacttgggaanaccgacacccacagaaaccgggggacacgcaagagggaacaggggggcaaaaagcccgcaaaagggcaagaaccgcaaaaaggccccgcaaccggccaaaacccaaaggcaacggccccccgaccaacaacacaaaaaacaaccgccaaagccaaaggggcgaaaccccaccaga

SEQ ID NO: 5468 - DNA, 316 bp, Bacillus thuringiensis
tactcaccacctactccattcgcagtgctgctagcaaaacaatggacgggggatatactaactaacactggcatgggccgacagaaacacgcacctacggcgatactattgggcaatcgtacactggcactcactggacatgacactcttcacggactagaatacctctatcacccatggacgtaagcaccgagctatcttgcaacaagatagctcgcatcacgacttaactacatcatcgactaggagcagcacctctctacttgaacagaccacttcatcaccagcatgtgcaggctacagtggtgtggaacct

SEQ ID NO: 5469 - DNA, 347 bp, Bacillus thuringiensis
atatgagagaccagtgaataaggtctaggaatgcaaacagcggaaaacgggggcatgtagcggcaaaatggggcacttggcgcgcatgaccgaacagaaatgatgtgaatattggatcaacaaggagctggacaggcgaatcaaacaattgcagagtatgatagaatgcaagagaccattatagatggctactaaactgatctgggcggaagttaataaagactatcgagtaccgaggagaattgcatataagcgcacgataagagcctagttgtggtccgaactgagctatgacctatgagaacgagagagaaggtcactataagaccgagcactataataggcgc

SEQ ID NO: 5470 - DNA, 149 bp, Bacillus thuringiensis
  unsure (1)...(149): unsure at all n locations
gagggggcgcaaaaaggggggactgacaagcaaaacngaacgnttgngcgaaaacancnggacggccagggaacngggggccagaggggacggaaaaaaagaggacccccaacaaaggacgagaagaagngaacnaacgaaaaaaaggg

SEQ ID NO: 5471 - DNA, 108 bp, Bacillus thuringiensis
aaggacgaaagaaaacatagccaatgaaagcaggttaacaaagaaggaacagaggcgagacgatggatataaaaattaaagggatacaaaaaacacttggaaaaacac

SEQ ID NO: 5472 - DNA, 198 bp, Bacillus thuringiensis
gcacggacggatacaatcgttctccacagcggctggactgatacatacacatacccacgcgccgaacgccatgagatgctaatcgtgtctatgcaaacaatggaatatgacgacgtattcacacgagttgcaaggaaggctgaacgactctgtaatccaaggagaatccttgctgtcgatgatgatcctataaacact

SEQ ID NO: 5473 - DNA, 346 bp, Bacillus thuringiensis
  unsure (1)...(346): unsure at all n locations
aaggcaaagaaatgaactggccanccagacggaaaagcaagggggaggacagccaaggaaagaaacggcggagaaaacggcgaangcaccacaaaccgcagaagagccaacgggacncaccgaaancgagcacgcgccacacggaagacgcccncaacaaaaagggcncggcacggcgaaagaagaggagcaccgcnaccaaaaccgggcacangaagngacaggaangaaagaanangcgaanncgccagcagaagcgcnancaggnggccaacgncaacgagccaggaacgcaacggcnccngcacaaggaacagaaacaccnggaacggangaaccaacaacg

SEQ ID NO: 5474 - DNA, 214 bp, Bacillus thuringiensis
  unsure (1)...(214): unsure at all n locations
gtgatcaatacccatacctgtacctttaactgctgctaagataataaatcagtgccgctccgatgaaaanaccncgcggagggcttttttcaccgaaagcacctcatataaaaatttcaataataccgagaaaaccaattacataaaacactagtttccacaaacatatgatcgactcctgatgtaaaaagacactcacctcaatatcaaatga

SEQ ID NO: 5475 - DNA, 302 bp, Bacillus thuringiensis
gaaggcgatacatgcacgcgcctacgcacgaggcccagtagacaagacaggaaggcagggacaaaggggggccgcaaaaagcgccgacgcccggaaagcaaaagaaacgacaggccaggcacccacgcgggcgcaaaaatgcaacagtgccgaaaaaaccggaaagcagcggaacaccgcgaaaggcaaggggaccgaaaaaaaaaaagcggaccagtacccccaccaaaatgtgtagaaccgcccacacaaaaaggcagtgggcgcgcacagcaagaagcacacacccagcccccaaaaaa

SEQ ID NO: 5476 - DNA, 135 bp, Bacillus thuringiensis
  unsure (1)...(135): unsure at all n locations
agaaagaacgcggaccacaaccgcaagcagcaaagaagaagccaacaaggcgagggaccacaacgnggaaccgaaccccagcaaaggacccagggggccaagagcccgaaagcaccaaaacggaacccaaaaggg

SEQ ID NO: 5477 - DNA, 473 bp, Bacillus thuringiensis
ccattaaagcggtacgcgagctgggctcagaacgtcgtgagtcagttcggtccctatgcgtggtgggcgtaggaaatttgagaggagctgcccttagctcgagaggaccgtaatggacgcaccgctggagtgccagacgttctgccaggggcatggctgggtagctgtgtgcggacgggatacaggctgagagcatctgatcgtgcacgccctgctgagacgagagctctcataacggaggctagtaagatccttgtaagcagatcaagctgatgggctcgcggtgggagcatggatgacatgccgagctgacgagtgctgctagatcggggactgaaccatatctattggaagagatgctagctacatttgaagggatatgccattatagcctggtggtgatggcagataggcctcaccccttttcaaacggacaaaggaggtaagctctttactgccccttgtaggtggga

SEQ ID NO: 5478 - DNA, 117 bp, Bacillus thuringiensis
gtgattgctcttaggaacagagatatttatgactagagaaaaggaagtaggtaaacaagcacgagagcaccccaagggggcatgtattcaagcttgatcccgctaagaacatacgac

SEQ ID NO: 5479 - DNA, 563 bp, Bacillus thuringiensis
  unsure (1)...(563): unsure at all n locations
actaaccacgggtgcatccttgcgtacaaacccacggtactacttttaccgcccaaaccgaaaacggagggggggggattgaacagcacgccgcgccggaacccactaactatgaagacgcaacagacaaaaaacgaagagaagcagcaagaaccgcaaggganactaggcccgtacattatacgtaactatacttgacagacttaaaacccgccgaatagcagccataagaacctataacagtcagtctatctagataacaagctggactacactacttgatcgttccatcgcatccaacatggtccacgaaaggacacgaaactgacatcatcgatgaaatgacctattcatagctagaactattgaaagcctcagctctctaaaaccagctatatataatctaagtgaagagaatctatactgctattcaaacgatatactctttcacaaacatatctataaacgctaacatggatgccaccataaccacaacaaacccaccctactattcatacattatgtaatctcgtgctcataatcattcttacagatagtagaaa

SEQ ID NO: 5480 - DNA, 161 bp, Bacillus thuringiensis
catgcgcggggccgctggctccatcagagggcacataccaaagcctggcgcactagtggagacggctgtaggccgccagaaaaagaactccgttcacccgtctacacaccatgctatgctgaagcagaaaccggagggcgcggccagcgtcaagagggagc

SEQ ID NO: 5481 - DNA, 426 bp, Bacillus thuringiensis
  unsure (1)...(426): unsure at all n locations
ttccgaaatgcgattcttccacactctatgcatgaaaatgnctcatttcccaaaagaacaagaaattcaaaaggggacaccgtcgcgaatgatcaagaaaaacatatactgtataaacacacatactcatacaccactcatatgaatccacaccatccactcactatctacatgtcagaacccatgacaaattcatgccgaatgtaatataaaagctacgttagggagcatctttaagaggaggtagagctcatctcaagcaagagccataggactgatcataacctaaaatgtgggacagtgaacctttcacagtaatgtaggacacgatacccacgaagcgctattataccattaagagagggaaagacagggcaggatcagaagacatatggtctcgaccactcacaccatgggtggcaaaga

SEQ ID NO: 5482 - DNA, 129 bp, Bacillus thuringiensis
catgtggggaaaaaagcgcggatgccccccatataaggggagccgtgtccaacaacaatgccatagacgcgaacaaaacgggccaaaaaaaaacccaaaagaaagggccaaaaccaaaaaaaccaaaaa

SEQ ID NO: 5483 - DNA, 168 bp, Bacillus thuringiensis
aaacaccaaggagggaaacttaaacccaaggaccacccgggtgcacaacggcaacaacgaagaaccaccggggagaaataagagggaaaacagcggcggcaaacccaaaacgacgggaaccgggaagacagccacacccggcgacagaaaaaaaggacacacacaaaa

SEQ ID NO: 5484 - DNA, 289 bp, Bacillus thuringiensis
aacgtaggataagagggacagactcccagcgaaccaaaagaagaaatactacaaggcgctacaaaggactcaggaatgcattttataaaaccgcccgaagagctttcaatgacataacacaaaaagcgtgcatacgaacatgacacaacacaccaacgtgctgagccgcatttaccaggcacaaatgacaacgaaagctaaatgcaattgcgcaaagggcatacagagggaagacactacggagtagtcgtacagcccggattgacaagctaaacatcccggaccacat

SEQ ID NO: 5485 - DNA, 163 bp, Bacillus thuringiensis
  unsure (1)...(163): unsure at all n locations
gagaagcaagncgacgaaggcagatctgcngaaaccccacacaaacataaaactccgaaggcaaaaacaccaacganggggccaaaaaaagaggcaaaaccgcggggaaaccaaccaacgaagggaaaaaaaagagccaacccgaaccaaagggaacacaaaa

SEQ ID NO: 5486 - DNA, 104 bp, Bacillus thuringiensis
tgcactttctgggacatgctaggttcatggcagcaacttgggatcacagaactttagaattaaaaaaccagaaggggccttagaggtcacccagtcagctgtgt

SEQ ID NO: 5487 - DNA, 169 bp, Bacillus thuringiensis
  unsure (1)...(169): unsure at all n locations
gaagagtaagggaaaaacaaccactcngtaannagcgcgggnngcaggaaaaacggggggcatggggaacaaaaaaaggaggcgcccccaggagacacaggaatggagcatgcacgaaagaggaggccagcccgggcagctcaacaacctgcccacacggatgaaaaag

SEQ ID NO: 5488 - DNA, 120 bp, Bacillus thuringiensis
  unsure (1)...(120): unsure at all n locations
accggctacaagaaactttagcttgatggattttggagaatncgccgcagattcatataaaacgggggtcccgtgtaatgctaaacgcaccttccaagcgatctgattctgccaggaaac

SEQ ID NO: 5489 - DNA, 551 bp, Bacillus thuringiensis
tcttgcaaaggaatgtggttttccaaccgcacctggcactacggaacacgggggacgacacgctccaaatcaacgggcgcaccttaagaacaaagggcgaaaaggggaccccaacaccagcggcgtcccaacctcgcaacacgtgacggacgaagcgaaccacgtgcgggaacataaacaacgcatgacgaagatgacaaatccctaccaaaaccgccatgatgtaagaaagatgaaaaccccataacacactgctgacagtgttatcaaaatagccaacccttccggaatagcgagacataaatcccgacaagatggcacataggcctccaacggaactatgacaatgatgaatacccatagggaacacatgcatcaagtctggaacagccactcaccctatagcgcggaccgtaatgagggtcccaagaaccacgaaatgctgaagaaactggagaaaaccggcgaccttacgatccggaccagataaaaacaaaccatatacacaagtctgactcggagagaacgaccaaacatataaggcattcaca

SEQ ID NO: 5490 - DNA, 235 bp, Bacillus thuringiensis
gctcatcggttgattaaagaatatgagcaataagctcttttatatagtacaaattaacgtacaactattccgccttgtaaacaaacgtggcgcaatggatcaaaaaactggatggccgattctataattaagcgctcaacgctttgaatcagtactctaccgaaaataatctcgcatgatagcatagcagaattatagcctctctttttattgacgtgtgcaacatatgttcaaa

SEQ ID NO: 5491 - DNA, 335 bp, Bacillus thuringiensis
aattcagagtacacccacacagacacatagacaactttaccgactgccttaaatgaagccagaacagggcgaccaagtcgaatagaaagccccatgccaatttgagcaaccgaaaccccaattacgcagcatactgaccggacaaaggcacccacacatgacacgcaaaactaaaagcaatatcttcaaagcacacacttcactacacgaaagatggaagaactgctacgacaggcgaaatgccgtctgagcgatctccgcaaacggatagacgaatcgcgttactaccgccactagctccgaagacccggtaccaccatacgcctgtgccagac

SEQ ID NO: 5492 - DNA, 133 bp, Bacillus thuringiensis
tataatcagggaagaccatttattttgtataagcgctccctaacgatcaatagtgcgcgagtaccgagagggaaaggagaggagcaccccgaacggggagcgactgagatcctgttaccgtgcgcctgcgaag

SEQ ID NO: 5493 - DNA, 180 bp, Bacillus thuringiensis
  unsure (1)...(180): unsure at all n locations
cttatgcgctcggcccctattcattagtaaanacagcgagagaaaccaaacacgaatgggggatccgagacacaacgcgaaggcagcatgcgagaaaccgagcgcaccctatagggagacaaaccaaagcaggacgcaaacaaaaacatagaccgcaaccagagagaaaaaaagattcga

SEQ ID NO: 5494 - DNA, 235 bp, Bacillus thuringiensis
  unsure (1)...(235): unsure at all n locations
gacgaagacagagtagttaccgggaaatgagttgtggncgggcagaacggggggaaccngcgggggggggaaggggggaaccgagggggggcgcgacagcaggaggcgaggnaccgagcngggcggaaaagggagacggaacagagcccggcggaaaaaaggagacagcaggcacacgggggaaagcgaaaaaccggcacacaaaagccacacaaacanacggagccgggaaagc

SEQ ID NO: 5495 - DNA, 190 bp, Bacillus thuringiensis
  unsure (1)...(190): unsure at all n locations
aaaaacgagcccctttgtccgtttttggaggancaagggcggagacatctagatcaaacttttgaataaacgtctccttttgtactaaaaaaatatctcttctgctcatctgtcataagcgacccactgcgagaacgccgccctttaaaagagcatacttctccttatacttcttcttgcagagggggta

SEQ ID NO: 5496 - DNA, 406 bp, Bacillus thuringiensis
  unsure (1)...(406): unsure at all n locations
gaagcgaggcgacgaaaccagatataaaagcaacagaccccttttgattattgagggatgacataccggacatggngagacaggagggcaaacaaaatgtaacacaacagcctagcaacagctactagacaaacatagaggtgcgaaccaagagcacggaacatctcaaaaaaagctagcaagacagggccacgaataggggcggtaagagcggcatgaaagaaggcgcaacccaagagagaagagccacgctgagatacaaacacacctggggaaacaaaaggcccaagaggggacacagaggcaacaaagcctgcataagcgacaagaatagaaggggcggcaaagcggggcatagccccaaagtcactcagaaaagaggcaccgaaaaatggaccaacgccag

SEQ ID NO: 5497 - DNA, 453 bp, Bacillus thuringiensis
  unsure (1)...(453): unsure at all n locations
ggcagaaacncnnganaaaatataatataaatacgcgcngggaanccagccaaaaagggcgggggnaagggagcggncccaaggggccaaccaagaaacacgagaganngaccaaccaaaagcagcaccccagaagcaggcaagagccccncccnagagcncacgaaagaaaanngaagcaacaccgcagcagaaaaagacaccaggggaaaggaaacggacggaaggacagcnaaannagcnacggcagaacgcacaccacgccaancaaanaanngccacgccncgacagcaanaacnngnaccaanagccggggcngaccaaaanaaagccaaacaaggagggacgccacgccaaagacaganaccccngcaaccggagagagnncgagagcanangcaccaaaaccaaanccaagnggaaccagggaagcngggccagcacgaagagcc

SEQ ID NO: 5498 - DNA, 156 bp, Bacillus thuringiensis
ggaactgtatacacctgaacaccttacgccactacgagcagtaacaccctcatctgtactttcgttgagaacagtgatatactaactacgactaccgtatatgaaggatatccctgcatcagttatattatgagctttagggcatactatataata

SEQ ID NO: 5499 - DNA, 242 bp, Bacillus thuringiensis
acacaaacacacccgaaacaattatccttcaccacccatcacacaaaggacccgacgcaaaggggaagcgaccctctgcggcatggcccgcacccccggaaaactaacatggagctcccaccctggccaaaggagtagggcaaaacgatgcataggaactttagccccggattgacctacaagtgtcattagtcaggcacaactcccagacgatccagtcacgcacggacatccacccacta

SEQ ID NO: 5500 - DNA, 383 bp, Bacillus thuringiensis
atacaatacgggcttttctagttgctacgagagaaccatcatattatgctgcatctgtagttgctaccgcaccgatgctactcataaaatcacccaacatcattctcaacaaagcatggcataaaaagccaatgacaaagctcctcaggttttcctagtacttcaaacgataccgtgtcgaaggtgggagcaatctacaagaacgttagagatcaccatgctcaccaaaatgctcacgctgacatatgcaacacttgagagcaaggcgcccaaaagcacgagagacccacctagctgcactctatcggctactactagcgcacattataccgactgctaaatgacgcccagactaattggacagctcgtactgttactaaaag

SEQ ID NO: 5501 - DNA, 321 bp, Bacillus thuringiensis
  unsure (1)...(321): unsure at all n locations
aaaaaacaaacgggaaaagagacaaagacagcggaccacttttttaaagaccaccacaaagcaacaccagcacaagggggcccggaaggagacacccaagagcgcccccaagaaacacaagaaaaaagaggacgaaaaaggagcagcaaaaacccaaacaccgaaacaaagagacacgaagaacacggncaagagcaaacggaaacaggcaacaacaagcaccgagacagcaacngacagcgaaangcaaagagccccacacgaagaaacagagccacccgcagaggaaaaaaaacaacgcaaaaccgcacggaaaacaac

SEQ ID NO: 5502 - DNA, 239 bp, Bacillus thuringiensis
  unsure (1)...(239): unsure at all n locations
caaaaaacgccattgcctcnataaagctagctagaaaggatgacattgggtatgaatcggtcaattcaggaggaattacaactcatagcggaagagcatgctatgggcgaaacacgctacgattccgaaggacacaataacaatatacgaggcgctacaggcaaactgaagaccgcaggatgtgacaaatggaccacatgtatttggggcagccgacgaaccgggagagataaatgcta

SEQ ID NO: 5503 - DNA, 215 bp, Bacillus thuringiensis
agaacaagacaaacaataccactcaaaaaaaaaaccaaaagaacaactctaaaagccacatgaccaagacccaaaaaccccacccccaaacaagcccaaaacggagaaaaccccccacaaaggccagaaggaaccacagccaaaggaacattaagcccaaacatagcgcgcaaacgacccacaaaaccgaaaacaaatcagggtcactgcacaaa

SEQ ID NO: 5504 - DNA, 225 bp, Bacillus thuringiensis
gttagaacaagcacatcctattttttcacatccaaacacaccaggacgggaagactttgtgacgcacactcgccgtctcctaccttataacagcatggatctaccacctggcagaggggcatacactacaaaggccaccgattccaactattatcagaacttcggcctcatccagggacgaagaatgattccaatggagcacatgcagacgctgatctaacaacc

SEQ ID NO: 5505 - DNA, 288 bp, Bacillus thuringiensis
gggaaccagacccgcgatcaagcaaaaagagcagaagatctagacacaatcgaggcaaattctctctagcgcccgagaccgccaagagaaccgaaggtaccggtgactaaatcacccaatgcgcaccgaaagagggaccaccaagggggaagcggtcaaatcacccattaaggcaagcagacaagggcacaagagagaggccagacgaccaggcggagggaacacaaaagcgcagaccacagcacacataccccaacaaccaaaagtaagatgtcagaacgcaaggaa

SEQ ID NO: 5506 - DNA, 102 bp, Bacillus thuringiensis
gcgacgaaaccagatcacagacacgcagcgcacgttttataaggtgaagagagcgatatcagaacactcgacggggggcgggcggaaaagcacaaaataacc

SEQ ID NO: 5507 - DNA, 480 bp, Bacillus thuringiensis
acagaccacagcgacagaaagtataatagacgagccaaacacaagacagagaacatgggagggaggacgtacaaaccagacgaggcgcagccattgcgcgacgacgacgtaatagcgccagtgggacgacccgccgcaccgatcgcacaaagcaaaggacaaaaagccaaggaagaattacgacaccaacgcgaccagaagacgcggcattcaccgcaacagggacggaacaagcagaggaaggacgatcagagacgacagaccaacaagaaggaaaaggaaaacctccgccaaatacagcaacacgcagacccaactggttcgccaaagacaacgactaccgaggaagaggccggaagaatggaacaggcttgacacgaccccaagcggagaataatcgggataaagaacgatccgaacctggcacagggtaagcaaacgaacacaaacccacggcaccaatgcaagcaaacagaaacc

SEQ ID NO: 5508 - DNA, 236 bp, Bacillus thuringiensis
  unsure (1)...(236): unsure at all n locations
aaaacacgaaaggccacccaccaagaccccgccgggnttttcgtaccccagacaagaacaagcaccaggcggacccaccagaggagaccgcgccgacaacacgccagacgcgcgccacgcaaaaggaaacccccacaagccaagggggagcccccacagccagacgagaaagccacgcaaagcaccggcaaaagcacgcagccccgccaaagnaaacgacacaccacaaccaagac

SEQ ID NO: 5509 - DNA, 260 bp, Bacillus thuringiensis
ggagagaaaggcgaacgattatcatctgctgggcagacgagatgaacacgacaggcaggacggccgaagacaaaagaacccgcaggaaccaaaccggtagacacccgcgagcgcgccaggccgagacgaaagacatcacgaaatcaggagccgagccaacacccggcagcagaaagcgaggcacccagcatacccaaacgtgagcccaactagagcgaggcgtgaccatggccaaagctgaatcccggagagattcgaaa

SEQ ID NO: 5510 - DNA, 390 bp, Bacillus thuringiensis
caggattaatactgggggggggcccagaaaggagccacacaacggagggaaagaggggatacgcaccgcaaagccaaaccaacaaaacaagtcggctacgcaagcgcggaggccccggaggccaaacaggaccacttaaagcaccaacgaccatcaaaatacaaacgtggatctgaagagccggatagagccaaaagaacgacggcgaaaccggcgcaacagcaggccccagcaaaaaggcgaagcgaaaaaacccaaccaggaaagaacgcccagtaagaaagcggcgagaacgccaaggcagtgttagacgagctacgcgaggacaagaagcacaaagcgtaataaaagaccacctcgcacaacagagacgcgaccttaacagaaaaa

SEQ ID NO: 5511 - DNA, 224 bp, Bacillus thuringiensis
  unsure (1)...(224): unsure at all n locations
cgcccacgagagccncnaaaaaaggggggcaaatgacaccgagagaaggccggaaaccagaaancgaaacaccgangnaaaacagagngaaaggaaagcaaagaaaacnaaacccgcaaggaggaggcaaacaaagggaanancgnaaaggaaagaaaccagaaacnaaaacggcaggaaacgaaccgaagacgacaagnaaagaggggaagaaccaacaagac

SEQ ID NO: 5512 - DNA, 267 bp, Bacillus thuringiensis
  unsure (1)...(267): unsure at all n locations
gcgagaaaaacggcggaataaaacccaacacacgcaaaggaacacacggggggcccacagaggcgagcaacggcggggccgccacgcagaaaccgagggaccnaatctgcaagagcataggaggcagcgacgcactcccaagtaaacacaccacaagcgcacatacgtgacaacaaaagccaacactatgctgcactaaatatcgaacaggaacacagaacagaagcaaagcatacgcagacaaaagagcacccctaaatgcaagcc

SEQ ID NO: 5513 - DNA, 235 bp, Bacillus thuringiensis
cagggacaaggacccaacgaccaatagacccagagaccaaaacaacaccgaggggggaggaaacgggggagaacccgccgccagcaacaccaaacagagaaggcacaaaccaacaaaaccagacaacaccgcgacaaacaacaaggacaaggccaggaccaaggaagaaacgacagccacacaagagcacaggcacgcaccacgaaccaagcaacccgaacaacgaccacggaac

SEQ ID NO: 5514 - DNA, 249 bp, Bacillus thuringiensis
gtgcttgagcgccgtacacaaacgttaaagattaagaagaggttttttggcgagtacaacctccttcgacattttgcgtgccgtacagcccgattggtgcgcgatcataacccctgggagattgccccactttctaggccataattgtatcttggagccagagtccttgtgggtgcaaaggatagaggacgcggcttgaacgaactgacggactgatcactgcatcctcggccggatcagcggcatact

SEQ ID NO: 5515 - DNA, 107 bp, Bacillus thuringiensis
gttgcattagaatgtgactgatgcttttaatttctgttgatgtgcaggtagtatattgcgcaagatgtggccgcggcaactatttagtaaccgacctgcacgaaagc

SEQ ID NO: 5516 - DNA, 265 bp, Bacillus thuringiensis
gatggccgcgctattccctggcccgagtaccacaaccgtatgactgtggattctttgtcgttaccaaacttaataacattgctcgacctaccgctatcgccagcttgcgtgatctcattcaggacccaagagctacgccttacaacacttgctacaacctgattggccactgctgactggatgcgtgaattacttgctggaagtcaactataattattgctttatcaacttatttgataatccatgagacaaaattcgcacactg

SEQ ID NO: 5517 - DNA, 242 bp, Bacillus thuringiensis
ccaaaatttcacagatgaatttttttgtcagagttctaaacaatcatcctaagtggaatattatagtacatgcactctgtggctatgaagttgtagctgctctataataatgcatgctcaacgaaatatattatagatagtgatgatctggactgccatctaggaagcaaatgggctgattggtacatccattgcgttgatgcaagatcgaattatgaaggcaacattccagtacggaggca

SEQ ID NO: 5518 - DNA, 215 bp, Bacillus thuringiensis
acacttatctcactactcatctcgatccttattgcacttaccaattggcgtcacactcggtttaacgagacctgacgggctgcggggatatcacatgatctatcctatgctcaatacagccattaatagccttcactctcttccatgcctcattctattattctttattttaccttctacacaagtgtctagcgtgaccgtccattgccctgcaa

SEQ ID NO: 5519 - DNA, 175 bp, Bacillus thuringiensis
acgcgcatggcgaggaatcacaccaccaccaatacactatctgcaattgcgcaaactatttatttaaaacactagctgccaaccctcgtgtactgagtgacaaaacaacatacacacgagtaacaacacatctgaaacctgaataattgagacacggaataaacaccttcacgat

SEQ ID NO: 5520 - DNA, 417 bp, Bacillus thuringiensis
gaatgaatcgggtatttatcatgagataaaagaagaccctggttagcttagaagtaaactgggtggacactacttaatcaaggacacctatcatacttacaaggataagcgagtacgttctacaccttctgcacgatatcagacacatatctcgagatgatacacgtacacaaggaggccatacactacaagtgatagtagccagtagcatacatctctttctacgaaaatgattccggtatttcacatgcatctatagtcgataagtagttctcaatgggtttatggatcctgcgaagaacttgtacttgcaacaatggaacgggctctgaatcagcagaagaaaatggaattacgcagagggcatttgaaaccagtgggtgaacaaacatattcgtacttaaactgatgttaatg

SEQ ID NO: 5521 - DNA, 408 bp, Bacillus thuringiensis
cctaatcttgacatgttggtaaatctgcttaattaacagcaatgcagtgcaccaaattctcaatgctcatgcgggctcctatctacatatccacggctgatacttcgggcccaccaccttactgcctctcaaacgactacagttcatgtcactggctgaaccggagctagaattggctaggcacacccgtcctacacttcatttgtatgctccacacctgtcgcatagatataaaaaacatatgggctttttcgtaagcataacgatcgcacatgtatgctcagctctgcgctggccgtgcaccatctacatgctttccggagatctcttggagcatcttctttcgcaacgataggtgaatgcacctaggatacaccgaaagcattcattaatactgcaacgtactta

SEQ ID NO: 5522 - DNA, 162 bp, Bacillus thuringiensis
tgcgtggcaccgatcttatcctatagggagtcaccttagagctcgtcgtaaccaaggatatagcctgtctctgtgcgagcttgatttccgctgacattctgcctcgacattccatccttacgactatcgtgttttgcatgggatgcctcgagagggagatta

SEQ ID NO: 5523 - DNA, 452 bp, Bacillus thuringiensis
gactgaactaccccattcgtaggaaagtgtccagctatcctcgctatcacgtgctgactctatggatatcgtgattaccattagtggtttaaaggacaaaaactattaaaaacaccctttaatgacgtacttacattgaatgaacctgacttaccttcatgtctttcttggacacttgaaccataggcagaatctcgcgacggactctataaacatatatgaatgcctcatactactgacatatatcctatgtaatgaacacttggattatacattacacgctttccactatgagagatatatatacatagatcataaacctatattaatcatttatcatccaagacatatgcctgattgtgaaaacatgcttaactactggcacgcaccagcgcgagaaactggcctatgaggcatatactgtgcctatacattagacaacatcccactac

SEQ ID NO: 5524 - DNA, 219 bp, Bacillus thuringiensis
aaaacaaatgataccattgcttttgcacttgctgacccagatggatgattcgctaacacgtctttgagcttctagctcacacatgacactatggggtcatctggaccaccgtgcgttatattgtaaataggaccaacgctttggcccgcacgagtctatgctactgctacattctggaatatatgaggagctagcatcggtaatggaacacggcgaagt

SEQ ID NO: 5525 - DNA, 217 bp, Bacillus thuringiensis
aaaccgaaattcaagcctccttaagacaacctaaaaccattcccatatatcactttaaaaacaatagaactcttgatatgctacgctcatcgcctcaaccggggctcgccaaacttttcatacactaacagtgagctgcacgatccgcaaaaagctacttaaataacgcgtataatgagcaacatttggtgactatataacttgacaagctttagat

SEQ ID NO: 5526 - DNA, 239 bp, Bacillus thuringiensis
tcgcttccttctcttgcttgcattaacggaatcagatgctataacgatctttcttccccaccaaaaactcccgttgcagatgctaacaactgcgtatatcggtagggaaatatattttctaagcgggatccccctaaacacactggcgaaagagaatgataaaacacattctaccataccaaaagaatctcaagtagctaaagagttggcccccataaggtcaagaaaacccaaaaaat

SEQ ID NO: 5527 - DNA, 150 bp, Bacillus thuringiensis
gtagctattgccaccccccccctcgtctgcaccagcgtactatcttgttttgtagctgaagcttttactagtgctagcggatatttttggaaaacaaaataactatttgtaagccccgactcaactgtagaaagatgactttcgttcaag

SEQ ID NO: 5528 - DNA, 354 bp, Bacillus thuringiensis
cttattgcgaagactcgatccctaccatcacacttttattgcatgctgggcaccgtgatcggattataatgaatccctttaaagaatggtgtaaacaccaacctgctggtaatctggaagtgcaagcttttcttgcacatttccgcactgcatacattcccgacgcatgccaccggaatacggggctgccgaatgaaagagcttactgacatgagttccctcgatctggctgtacgatattacccgtggaaaaacgatttgccatcagatataaagcagcgtgcgccatgccatgatagggggcaggcctattgaccgcacatacacatttctgctaactgtacatcctgtgct

SEQ ID NO: 5529 - DNA, 568 bp, Bacillus thuringiensis
catgggcaatttacaccgaagcctggttatatttactcagaacacattccgccttgaataggaggcgtatagaaacaatggcattgggtattcattaatgaaagaattaaccaaatcagcgatggaaagagagcctatgaccttagctgccggaatagatgcagcgattgagataagcattgcccagcttcataactacgtattcgcgcatgcctgaacaactgacaaagctcgttctaagcttaagacatggctcgagccagctcacatatcccctggaccttaccggtgcctgaaaatccgagcgaacaatatagattgctcgggtgcaagtactactttatgcacccgttttcctaacttaattgcctttggtgaggttttttacactcaatgtagaattattagaatccaatatcacgtactaaaccgagcctcagatatggaaactgttattaatgagctaacaaaggcacaagcaaattatggggtaatggactatgaacctccaaaagataatcctgtagctgcttcgctaatatcgacttgaatgtccatggtagcatct

SEQ ID NO: 5530 - DNA, 114 bp, Bacillus thuringiensis
cgccatcatagcgggtacataccctaataaagatgcaccaattccggcaccaaatgagtctacagaaagagcgataccaataagccatgctcttcctgcagaacaggcgcctga

SEQ ID NO: 5531 - DNA, 134 bp, Bacillus thuringiensis
gactgaccgcgcatgcgcagcagttccatacagatggatggtatgagcataatactatatggaaccacagagcttgcctaccagagcatcaaaagaacgctgtggcccactggctagccctaccgaataactac

SEQ ID NO: 5532 - DNA, 485 bp, Bacillus thuringiensis
gctacattgaactaaaactccatttttgcttgattgggtgcgacgcgaagctactattagatcatataattaacaatggatgattattcctggaactcgatacgtaacactgtgtgaggactgctggatctccgagctgaacatggagagagttcgatagctatctcgggttagtttgcttctagaatggacgctgcatgacgcacatcgccaatcagcatttggagctgattcgcctacgcgatgatataccgaaaatgcactggttgctattgagtgagacggctctcatctgtatgaccaggactgactgccctcttataaaaacggatagacttccgggcccatgtacattgctggattggaccggatgcggttagagacacaaatgttgtcgcgcgctctgacgctctgaaggcatcagactttttagacaggggcgaggaggtaatacgagtgggctgaccgatgttctaggccgcaat

SEQ ID NO: 5533 - DNA, 448 bp, Bacillus thuringiensis
ctatcgtgcatgaaattctccaacttgagattgagctacagtcagcgtacctaatgatgaactatcaactacagctccagtatgcgcttgtccacatgccattagaccctcaggtagctgcacacctgacttaagaggatccacgctggcggactctgtaccctctgatgtcctctctacgaccaaactgggaacataacgctgtacccctactggccctctgtgaagcacgtgattttgcctagctctatctgcttgcaatacatgccgcccacgacggccgtctctaaaggctgcatgcctctaccgtctaatgtcaccaactaatgctcaccctgcatgcccattggctgcggcagactgtataatcttcttaactgctactaaatattgcattccaatcgcttcatgttatggcatgatagcctctaccgtcataagcccacgt

SEQ ID NO: 5534 - DNA, 115 bp, Bacillus thuringiensis
cgacctacccgacggaagaaccccaaaaggcagaagaccttttgtcagcgaatctaaaaatgaacaccaggcccaaacggaaggagaccgggacgacaagcaggggagacccaca

SEQ ID NO: 5535 - DNA, 236 bp, Bacillus thuringiensis
acaccagaccaattacttcagatacctgttaattggacgattttatatcacgatattgatgcatacccgttccagagctctgtctactcatgaaaaactttaatcatccgtcactcaagcggacttttacaggccgtagggcacctacctaactcacttgctgacgcccaagctcgcggtcgcggtcttcactgcccgcacatgcgggaccgaccaattaactggccgctattata

SEQ ID NO: 5536 - DNA, 166 bp, Bacillus thuringiensis
gcgccagatttcgggaccagatgtcgggatctgccggattgaaaatcgggcatgtacaacccgctgtgtttaacaatgctgccgctatcgcaaatatacgcgcaggcgaataaaagcccttgagacaatgcggggtattgaccacacgataccgataccagcgaat

SEQ ID NO: 5537 - DNA, 111 bp, Bacillus thuringiensis
ccataaggaaccttatactgctcaacatgcttcacacaatttttttttctatcagtatctctccaaataatcgggggcaatttaagtaaccccggtgtctctataaactcc

SEQ ID NO: 5538 - DNA, 108 bp, Bacillus thuringiensis
  unsure (1)...(108): unsure at all n locations
taaangcaanaaatagcgggtgtataattttagaggggtnttatcgggagtatctctataattcgaacaaaaaaatatgtagtttgcaataaaaaattagatgagaaa

SEQ ID NO: 5539 - DNA, 211 bp, Bacillus thuringiensis
  unsure (1)...(211): unsure at all n locations
cggccccacaccgtgtggtctatatctcgcctactctcgaaacgcgtgtccacatacacatatcggccatcccatgacccgtttctgaacacaggcctcatcactcgcgcaaggcgacaacctaaagccccnccgcctagacaaagaccgcgtcgtctggcgaatctcacgataaggctgcgtccccatgacaatgcgtgacactagcaat

SEQ ID NO: 5540 - DNA, 389 bp, Bacillus thuringiensis
gacgctccgcagactccggtttagcttactatccagacactctttttttctgtctcaccactcaatacatgcctcgagctcttcactgaacgctcaaactaggttagctacatgcctaacattatgctttgcccacatgtgcaactaggtccttggtatcactagcataaaagactatgctaagagcgatagctcactctagctatgttagctacatatattgtgtgaccagtgcccgctctacatcacatgcacaaaggtccattccctgattagaatagttatcaatcatgaactgaaactcgtctactggctctttagttaacaccttaccatcacactgcatctctaatccctactaatcaaaacacgcggctcaataaacatta

SEQ ID NO: 5541 - DNA, 423 bp, Bacillus thuringiensis
gcgacgcgcgtctttgatccgaatccgcgattcgcaactgaaatggccaacgtcgtgaacgaccgtctgggcattgtttttggctgctgatgcgatatgccgctgcgcgagtctgcgacgcatatctagaatcggctgtccgaataaatcggatcgcttatttcattttaagagacttggtctcccgtcgattctctgtgctgtgtatgtatcggggaccaagcaattccaccggcaacaactgccatgaccgtgacactttcaaaaagtagccactctacacgcacttaaaggcggtttgggaaagcgcatcttcggttattcattagatgcgctgaatgacgcaggaaacagtccaacaccgctcagatcagacgtgcataatgctcctgggaaacctctctctccggtgaactctgtgta

SEQ ID NO: 5542 - DNA, 238 bp, Bacillus thuringiensis
gcgcgtccgtctttttgcagactgacgtgagtgaagctacctatctaccgagattctctaggaaacaatttctgctttctttttctgatgctgactccgcgcggcacctgcctaagctatctggagacctcactcgtgggggcctgccctactcgccgttgtgtagattactgccaggcagaagggcgtacacatctggacgcagtggtgttacaacaccgagacgggtatacccatg

SEQ ID NO: 5543 - DNA, 191 bp, Bacillus thuringiensis
gcgtacgtattgatccgaattcgcgattcagctcctctcaacaaaaatagggaggtcacgagacacatcactttgtttgcctttgaaaggcggtgactagcttgtggaggccaagcctcctctaaatgaccgagccgtttttcccataacgccggccattgattaatatagggtaactgcaaaggcccctc

SEQ ID NO: 5544 - DNA, 362 bp, Bacillus thuringiensis
  unsure (1)...(362): unsure at all n locations
agctgccatacccaagagcgttttcacatcggccaacaaacttctaccatccaccgtctgaccacaagaaccaacctnaanatgcgctattgaaggggtcatcgtacatgcctgcggcgctacactccatatgattgatgacagcgctgccatcgtacgatgcgcacaactcgagccctgtgtgaaaacggacataccggcgactactatagtaattatcagccaccacttctgggagatcactgctatgaaccgacatgaccgcatgctgatgaaatgctgggactcgctgagctctcagtcattaacgatagtcacgcaatggccgatctagcaataaccactgagcatacagatcgaga

SEQ ID NO: 5545 - DNA, 150 bp, Bacillus thuringiensis
gaaaccaaaaccaaaagagaaaccttccccccaacgaaagaaaaaacagaagaggaggggaaagcaaggggaaaaccgccggaacaaccccaccaaaaaggggaggggaccaccgaaaaacccacccaccaaacccacaaagcaacccgc

SEQ ID NO: 5546 - DNA, 409 bp, Bacillus thuringiensis
  unsure (1)...(409): unsure at all n locations
caaaaggggaacaggagcacaaaagaaaacganaacgaaaaacagaacaancaagcgaagggaggaacaaacangcacaaacaggacgaagaaacaaagcaagcnggagagacaaaacgaacacgacgagaccaagaggaaaacggaaaaaaccaacccccggaacgaagagaggggaacacacgccagaaaacagacggggaaaccgccagaaccaaaaaaaacgcggaagcgaaagaagcgacaggaacaacgcaccaagagacgcagcagacaacaacggaaaaagaaagaacggagcaaagaagaaacagcgaaaacccacgcgagcgngaagagaaccaagaaacgaaagacacgccagaaaaacaaggggaaacgccagacgaaaaaaaggagcaaaagcaac

SEQ ID NO: 5547 - DNA, 443 bp, Bacillus thuringiensis
  unsure (1)...(443): unsure at all n locations
cgtgatccttttaacaactcatacattaataatgtatatccacggccctcgcaaaaccgacaaaaacaactgnataattgggaatcttaggagacctaacccggtaaaacacacacatacacaactagtatcacacgatcttttactttctcatcctaattcataactagttatacaattgaaccaacagtgagggatcgcctgagcttttacataaagattaaaacaactttgattacacggaataactacattatttaaaatgagaaaaaacccacaagcgcccattttattctctgatcataataaacaacgctcgaaaaaaagacatagaacgcatccacaatctaattaaacaactgaacgatcaatacccaaagaataaaaccgtacggcttcttttgatcgaatctcagagaaaacaactagaaaaacacttacac

SEQ ID NO: 5548 - DNA, 460 bp, Bacillus thuringiensis
  unsure (1)...(460): unsure at all n locations
ccttgcaaggcatctcgggtgtgggaccgtgaatccaggccggctaccaccccggtgagtggttctatcaaaagttcgggggcttgacgacgagtcgccccgattgcatctatgacgggttttacctgtcgatgctgaccccgttgacaagacgcacccatcgtttcaaggcacgcatgacgtcgaggtcatgacgtggtgggtcagccaacaaggcatggacgacgaccgccaagactggcacgatgaccagcacaacccgccactgcgtcaccacataacccacgacaccgattcccagaccagtgaggccatgaacgcgactacgacggtgtagccgcgagaaccaattgtccactcttgtccacaagcttgtggattgccctgtggataactggtgaatcngagcgatgccgatgcctaccatgaccactcccccgacgagaagtcctgcgagcag

SEQ ID NO: 5549 - DNA, 378 bp, Bacillus thuringiensis
gcgtgggaggctttaaggctggctactataaaaggcggattttttgtaacgtgcggtgtcttcgttagaaacgggatatgaggcataacgaacatatttgatctattatgtagaggcgcctttactacgggtgttgacgcttgactgaggctagggcttgataaggcagggtaacgaacaacaaccgcgggcgtagctttacgagcgggcacggcattcactatagcttctgcaaacagcagggcgaactagggtagatgatcctgggcggacttcaaacgatcattctattacagagttgcaggcgtgatagctgagtcagaagttcgttctttattttactccggaacgggggggccagcgcttggcgtatcggtg

SEQ ID NO: 5550 - DNA, 313 bp, Bacillus thuringiensis
ggaaaaacgtggccaattcctattacttgtgacagcagccttttttttgcaattaataccttttattcagcgctggtgtatcaacaagcgcaccagagaggctttcagacaaagtggctggcgcgtgatgtaacactggaacatcgacctaatgatggtcatctagatacaaaacgacagggactattggtatagtagatgaatgatccagtgtgctgatctcaaaactgatgtccaagtggtgtaacaagagaactgactggctatactgagaaacgaggagggcaatccacaatataaatttatacaatgt

SEQ ID NO: 5551 - DNA, 302 bp, Bacillus thuringiensis
cctatattattttacccttacaggtcaatgagggatatctgagggctatcgagacgatcctacgagccttgcgacattatcaggtcaaagacaagagggtatctattcgatatactcatataggtggcttctcacttctaccgtgcacgtataaacaccttgtctggtccgaatcaagaatggtgtccatagtacaggctgcagggatgatcgcgactgcactggtgattccgtatccacctgaacacccatcgatttgtctggagagagaattacttcagcgcatatagagcagatcatgt

SEQ ID NO: 5552 - DNA, 226 bp, Bacillus thuringiensis
tgctgctgcctcgcttagttgtcttacactacaacaatatctgttttttccttcactcatgtacgggcgggagtattctgcatatctgtatacagcactgctctagaaccgtgacacaaattgatatactacattttgatatgctggagagattccacctactctgcgagatgctgctttaactttaccaactgtgtatattattgcacaatacgctctttgatac

SEQ ID NO: 5553 - DNA, 194 bp, Bacillus thuringiensis
tgaaacattgaatgaatgcattcgctggaggctgctggttgactgcaacttgtgccggtgacgaataagtcggttgcatcgcgcatagatcacctccagtgttcttctgactgcatgctacatggtgtctgtccaacctcatcaacgtatcgtattggatgtggaatcacggttaccgcgctagaataaaatgc

SEQ ID NO: 5554 - DNA, 397 bp, Bacillus thuringiensis
  unsure (1)...(397): unsure at all n locations
cctctgctcaagctgctcgacgacaacttctgatcctaatcctggatcattcctcaacgcgtatgcctccaacagctgttccgctctttccctctagcgaggccnnnnanacttggcgtaaccatgaacatccctgcgtgctgtgggaactcgatttccgctctcaacttcacaccccactgtatgcccatgcacttagatgcactcactgggaagcctatgaggtgaactaactcacatcacacaggcgagcgctcgactgtacccgtttccagtctttcatacctctcgcgccatatgcatcaatgagtccgacatgtcgctgagagacgcccattagttattagccacctactcgatgaccttgtaaatagaccaatgggactccaccatctgc

SEQ ID NO: 5555 - DNA, 276 bp, Bacillus thuringiensis
ctagccccccacacgtggggtctagatctcccctgctctcgaaactcgtcgtcacaaactcataagtcctacttctgtacccttttttatccacaaccacagaaggcttcacacccacctgtgcttacactgcttttttttatactggtcggccgattcgtgataggtctttgctgtctgaaatacttatgcgctcacaatgacacacgacttacatgccggtcgcataaatcgttaagcctgtggtgcctaacgagtgacctaactcacattatt

SEQ ID NO: 5556 - DNA, 222 bp, Bacillus thuringiensis
ttcgtgacggttccgcacgtcttacgatgcgttttgaaaattttttttctacctttacggggctgaaatcggacatttggtgtgggatttgaactaacattcgctcaatgtgatacagcgacttttagagccttgaaatgtctggttaccggactagccgtcgtccttcaccccgaaaccatggacccattatttttcacactacgacgcacttgggactga

SEQ ID NO: 5557 - DNA, 127 bp, Bacillus thuringiensis
gagtcccgctgctgcctgccgcgcgctactatcaatggcgccattatttttaccagcgtcgaccactttaaaaaacgggggggcatgattaacaacatctattatatatgcatcgccggggcccata

SEQ ID NO: 5558 - DNA, 188 bp, Bacillus thuringiensis
ctccaaaaggagcgatttctgctgcagcattattatgcctggaaggtgatttgcccgctcgtatagctccaatgatcaagatgaagaccctcgctgtcaaccaatgggattccaactttcttgcttactgaaaatgtttgccttctgatcactggcggctgttgcatctgtatacctggcaggccaat

SEQ ID NO: 5559 - DNA, 115 bp, Bacillus thuringiensis
gcgctaagacgcggagcacctgattttttagcggcacacaccgcaatgggagcgaggcacgatgactttccaaacttaagcgcacttgcactacagtacaactgtcggccgtggc

SEQ ID NO: 5560 - DNA, 337 bp, Bacillus thuringiensis
cgcgtgatgtcagcactatcatatccatgtctccccacgttacaatggtttgtttccatggctgtacgtataaagatccctatgtatctagttcatgaaatgaaatccctaccttcacgactgggagcggttttcctaagaacttcatacatagatccggcacagagggaattgttccaggccttacctgtcctgaattcatatgttctaccttacatcctgtatccgatgcctgtactgcctaaagattcgcgggtaagaggtccaccagagattttatatgctggggcatctgatccttcatgatcaaatataacagtcgtagttgatgcctacg

SEQ ID NO: 5561 - DNA, 168 bp, Bacillus thuringiensis
cgtgataacgcggcgatgcttctcctcgtagacaggcacgaaaaggtttttttcaactataaactggtgaaaaatccggatgtagctgctcatactcggaaatagccacctataaatacagggcgtcgtttgatggtaatattaattacggcctgagggcacagggga

SEQ ID NO: 5562 - DNA, 207 bp, Bacillus thuringiensis
tatatttttggaccgggtgggttatactgaatgtatgcagacgaatcatatctgcagcaatatagagaagggaaattactgatagcgttccagataatcatggctgagtggacgatcttatataacgtactggtacttacataagccatgctatttaattccgaagatgggcttgctggtgcttatgcatggttcatttaaggtgta

SEQ ID NO: 5563 - DNA, 119 bp, Bacillus thuringiensis
gccttttgtttcggatccgaatccgtgctgtgcacctgcaacactgtcatgtacgcattcgttggaggcattttttttatagtaacgttgtgctcggatcacgcattgaggtggtacca

SEQ ID NO: 5564 - DNA, 384 bp, Bacillus thuringiensis
gtcatattctagataatcatatgcatgccctcttactgtgtagccagcttcagctaagttataccctaagttatgatttccattaccggatatcgatgagttatctgcagtgaatataccacactggtagccaacgccaatctcctgcgacatattacagctaccttgagttcataacgaactctcacaactggacccatcgtcgggataatacctatatgctgaatacagtgaccaattccacgattggactcaagtgtttgcgtccatccagccatgatacggtcaatggcctatgctaggaccatgattggctgctgacacgcccgaatgaccgcatgagccgtccctagacgaccatcaactgaatcttatacgacctta

SEQ ID NO: 5565 - DNA, 348 bp, Bacillus thuringiensis
catggcatacccatacaaaaatatacggagtccatatatgatttaagtccataccatacatgtataaaagcctgtggctaaccgatatccgacactgcgatccatatgcccagcgcacagcctatgctgtgctgattgactaaactccctcttcctatatcgaaacattgacccgacctactaattacgaactgatcaggccacgtgctatcagcgtacagaatgccttgacctaactaaacaatgtccatcgtatcgatgagcacatcaaacaccgctaagtatggcctatcaggagatgcataccacactaaccagtctggatattacgtaattaaccacggtgct

SEQ ID NO: 5566 - DNA, 186 bp, Bacillus thuringiensis
tcatcatgtggcagagatctacgggtttgttccaaatcaagcggttactgcagtaaaaacctgtgtgcaccaggccggcttgaggcccccagccgccattaggccaggtcgctggcgtttttgcacatgctgcgtccgcccatcgcgcaccacctatatcgatcgatcaagtctggaagtggcaga

SEQ ID NO: 5567 - DNA, 322 bp, Bacillus thuringiensis
cctgacaggaaaacggtatcttattcaacggtgtggattttttctgcatgggaccaaagcaaaatgcacatatgactcacatacaaacggtaatatttcacaaaccatctatgtaccggaaggacgaagcggtaatgacctgctcttatcaagtgatatggaattacagaaccgcgtggagcatatacgtgctaacaagttttagacgtttcacggtagtgaacctttcttagatcgcccatttacggggatgacgaacccatacaaaggtgaaggtttaactatggcggggaaccatgcttgttaacgaagatggtcgaac

SEQ ID NO: 5568 - DNA, 161 bp, Bacillus thuringiensis
cggaacatgaatggctaaaacttttttctaagacgcacgtggccaatcatgatcaaggcatctacttaaatccgaaaattgatatctggacaagcgcttggatagccagtgttggccctgggatttgcacctaatgttaaggtgcatgaaaaggacatttg

SEQ ID NO: 5569 - DNA, 496 bp, Bacillus thuringiensis
tatttaattaccttatgtaagtgattgtaatatagtcacttactttagtcaagtaacttttaataaaaaataaaatctcgacttaaaaatattaagcgagatacaattgaacaccaaatacatctttattacttgtataataaacttagagaggaaaattcatatatagaaaggatttattcatgagcactatagaaaagattcaaacttttattattctttttgctgttacatgcggcatcgtactcggacaatttaatatgatacatacgtattcagacaaatttattgtccccttcttatttttcatgctatatggattattcctcagcatcccattaaaagaaataaaaaaaggatttcgcaatttaaaatttgctggaacaagtcttactattaacttcttatggacacctttactcgcttgggggttaggggcactatttctttgcgatcatccagcactttgggttgggtttataatgttaatggttac

SEQ ID NO: 5570 - DNA, 246 bp, Bacillus thuringiensis
cgaaaaaataattttttattcttattacggaatatgaaatttatctcgagagtttatatgctatacagtttttagggataattctatcctgaaatgattcgtgttttttcaccgcatgttacacaaggcccagttaattgagaatgtattcaaattaactatatagcataactctttaactaatgatgcaggttacttgaggaaagtacttaaccatggagaattgcctatgtctatcaacaggtg

SEQ ID NO: 5571 - DNA, 136 bp, Bacillus thuringiensis
cccccacgtgtggtgttatagctagcctctgcgctagaagcgcgtggacacaaacacatatagacatggcctacaaatattttgactgctaaggctgaagagggaatgccttgattaattgcggcaactgacactg

SEQ ID NO: 5572 - DNA, 198 bp, Bacillus thuringiensis
gagatggattaattcctgactcacacagtgcggctgacccaacaccatgaaatctaataaatcgggtggcccggaaagctcgtgcactaatgacagcacaaccggaatcatcactaataagcactccaccagtccttgcggtcagagtaaactgaccttagaacgctaacgaaccactgagacaataggtataaatcc

SEQ ID NO: 5573 - DNA, 378 bp, Bacillus thuringiensis
gtatattgacgttcattcgaggtacccttcggcagccacattttatttctaatccattaaagcccaaaaacgtggtgaggcttggcattcaattccctgtgttattaattcctgctacacttactttaataatggttggccttattcatttcccgatgtccccaatttttttattccatcatattacacttgttaattgctttccaaacatttttatcatcgatcttttcatgccgtcggttatttgtcggatattaaaacttgattcttttatatcccaactttttaagctaccaatactatttttctcttaattttaatcgcgccttagatcgtgtatagtttgccaattattatccaccctttctcgatttaaaa

SEQ ID NO: 5574 - DNA, 366 bp, Bacillus thuringiensis
aacgatcatcctacacctttcactgaggacccatgactagtttgatcgctgtacatgcacggcgtttctcactatgacgcacactattaacttgtaccgcatcctatcatttgcttcttgtcaggcattaataaaccgattgggatttggacgctgcatacggtagacagtgatgcctgtgagacacatatcattgacaaggccactcctctaatggcacaacgggtcagtgaaacgggttatgacaccgtagcgtccccattccaggatccgctactttacgcgcttcgccagagcctggtaccaaccgtttctcattgtgagtcgcttgactgtacgcacaatataccgtccttgtgatttaca

SEQ ID NO: 5575 - DNA, 451 bp, Bacillus thuringiensis
gctgtttggatggaaacagctttcccgaccacattctctattttagggtacgccatactagcgtaacacgtttagacatcactacttagaacgttggtgatggcaaaggtaccatttgattcatgaatgaccggggagcagggaaccagactctactgctcattactgcagcgcgcatgagatgacatatgcggtgcatggcccgcagagaagatcatgatggttccttacgaagatgacgggggaagtagcgatctatctggcggagcatgctatttgagacctagcgtggtgcagaccacacgtgtggaggccacgaactcggagccgatgcactgatagagacgcacgaggtggccatgcacatggctgcacgtaacatgacaacgctgagggtgagatacccccgtccgtacccagactgacacgtcacgctatatatgcgtctacc

SEQ ID NO: 5576 - DNA, 199 bp, Bacillus thuringiensis
ccgaccgctgcaactacaaaatcttaaacggctcctgagtcttctttaacctctgaaacgctcacacgctcaacacctggtcttgcagtaatcgtaactcttgtgccaagtgaccatgcaccaagaaggcgtatcatgaacagacctgtctgcacgcctactacattagcgactactgtatcatgaagaaagactggac

SEQ ID NO: 5577 - DNA, 460 bp, Bacillus thuringiensis
gaatggaatcgaactaagaacgggtccattgaagtaccatttttgttcatgtttccacaccttaagacccaggccttttatattaacggcttaatgactgtcaaacagggagaaagcgcgctgcttcacaaatagctctggcatagttgtatatagtataagtgtagcatagcccctaatgccctatctaccgggcgcacatctattaatagctcgaatgtgatactggccatacgaataccggcggcatggtctataagcacgggctgtgctgcatccgcacctaatacatgtagcggaataactgcgcgttaaaggcacatgctgagacataagctctctaataccagcctctgttagttgcgagtgctaagtgacacaacgcatgactcttaattgcatgttattctaaagctcaacagatagcggcgcacctatgagaagacctggcaaacgaatg

SEQ ID NO: 5578 - DNA, 449 bp, Bacillus thuringiensis
tgttgcgaagagttcatatgcatgatatataggttgaccctcatgggaagcgtttaagttcatcgaataaaggattatgaatttctcggattagctgcactgtttccgactgtatgttcaagtatgtacattgttacaataatcctaccttcctcgacaggttatcacgtatcatacacagcaagaacggtagcccaagcacgtgctagagcttgcatatccactacggtgctcgcttctgttataactactacttatatgagtaaacgaacctgcttcagtgattgttttcgatcgacagacacctgcacacctctttgttttgttggatggcactggggacatataacattgagatgtctttcaagactgatgccatacgattgagcgactgttcctgcaaaccttttcccgtttgattgagagagtatatttgcgttaatgttttc

SEQ ID NO: 5579 - DNA, 214 bp, Bacillus thuringiensis
cgtgatgagggaggatgcacagacaaataacgcgttgccgatccatttttcttatccttctatgacgagacaatcatatgcgaagctaatgtattctaagcattttccacccggaaaatactttgttgtacctctttaaagacatcacatgcttttggaaatgactcttgaagatgtgtgaccatgcgctccatctattgactacatcggacca

SEQ ID NO: 5580 - DNA, 114 bp, Bacillus thuringiensis
tgcttgaaggcataattattagttattcatgcaagcggtaacccatcacgagggggagcatctagagttcgttcgagtaacaaactttgtacaattgctccaagatgtcacgta

SEQ ID NO: 5581 - DNA, 363 bp, Bacillus thuringiensis
gaccctacttaatgtactgttgttcgacaggcgacaagtgtttttttccgtcctttccccaaacaggtgatacgggggagaggcatggaacaaggagctttcctaataccttaggtccaagtgggggccataccgtccaatatttatttttgatagtcccagctaattcgttccgcgtcgcaccagtttaccttacgctgtcggaataaaatggttatgtactttcacacgctttttataagaagccttataaaacccctacaatgaaagagtcattttattatgtctttcacacgtttagcggaacacaaaaaaaggggaaaagcaattaaagcgtttataatgtttgaaaagggaataaaa

SEQ ID NO: 5582 - DNA, 167 bp, Bacillus thuringiensis
cccactgaaagtattagcatacttattcacgttaaaggattgatatccggagcggtcagccattggagacgaagattcagcaatgacttatttaatacccattgtctgtatatcttgtgcagaacgctctggtgctatgaatgagactggtgttgtaacatctgatt

SEQ ID NO: 5583 - DNA, 174 bp, Bacillus thuringiensis
atcgatcccacttcgtgatcctctattcaaggcttaatcacgcatcgacgattacctatacttatcccccatgtacgagtcagcactatgggagggcattgcatcttaagcatttgcagctacaacaataccctgatcgaccttttcaaatgcatctgctgcttagagaaatga

SEQ ID NO: 5584 - DNA, 331 bp, Bacillus thuringiensis
cttgagtgaggggttatattatggaacatctcgaacaaccacacctgctttgtatatacttagcgaaccttaacaatgggggtggtggtttacaagcgcatggactggaggtgcgtgggcgcaaacctgtcgtgttatgagatgatggggcaagtcctattgcatgcgctcccattgatctgaatcgccattggtagattgtgcactctactgtgactgccggtgacaaaccgaaggtaggtggggatcatatgaccatctgaattcaagatgcaccggaggcacgagattgctaaattggaccgtataaaaacgttccagaccataaagt

SEQ ID NO: 5585 - DNA, 136 bp, Bacillus thuringiensis
tgcagtgaacagagttttttttactacggaactaaatgacgcatactgcggaaccctgggatgagggtgaaatggatatcactctagcgggccggtatgatcattctccggtgattgacgaacttacgcacaacag

SEQ ID NO: 5586 - DNA, 391 bp, Bacillus thuringiensis
catgaatgatgtaaacgattgcatcgtactcatcacatttatctcggtcgagcccatacttaacagcttctgagactacccaactggcggtaccactgctaaccacatccctatcccgtacacatgttccaaccctaatacccccatacacggctttgatgctggtccatacgccgatgctcgtggatgcggtcaacagtcacacactgaccgccctaccgtgtgcaccgtttcactgcatacaacggggagccgattatcatacgcagctggcagtggacccggaacgagtcacggtagtgcgaaaagcgcttcttggactgctacactgttgctgactcacgatcgaagctggctttaaacgccgttacgctgacgttacactatccgc

SEQ ID NO: 5587 - DNA, 190 bp, Bacillus thuringiensis
gtgagcactgcgagcgagacatctctagataacgaccaggttttttcaacctctgaaatccgtagaaacgcgggtcctcgtatcggaacgacggaacaagtggtgcctagtggctgtctaccaggaacacgactctttgccagatccctaggtacgagccctgccgtggcaactactcggccctgtaaaa

SEQ ID NO: 5588 - DNA, 294 bp, Bacillus thuringiensis
gactgcggacggctagaatggggtgcttgcagcaacgcttttctttgtattcgcacaccatcatacccaggtggaggttatttactgcatttcgtcgtttcactatcaatgaactgggcatctttattccacacgcgggcgggctccaccattgtgcacctgttgtatatgcactaatactcattcttccctacctgacccgcctgactttcgcccacgtgattgccggtcgtaaccctacctgctagcatccctttaaactagagctgtcttgcgaccacccctaattttttt

SEQ ID NO: 5589 - DNA, 161 bp, Bacillus thuringiensis
cattaatgaccttacagctatagaaatgtcttctaacgttttatggtctaaaacagcgatgaatgtcgcacgcggggcatatgtgagaggaggtgcgtgagatctaccccccaaagcatttgatacgaggctgatatattctagacagtctggacttggtg

SEQ ID NO: 5590 - DNA, 222 bp, Bacillus thuringiensis
cttatatattcatctaatatcacaccataggcgccaccacccataaatggcatccctaactgctcacctatatcagctatcgctccatccgctgcagttacatatatcacaacgtctgaccacttttgtctctgctgcacaaactacgaccgaggctgaaacccctgaatcatcttgcgcaaatgcgactcctatgagagaaaacgatggtcgcgcggctaa

SEQ ID NO: 5591 - DNA, 177 bp, Bacillus thuringiensis
gctggtgaagatacagatgaagttatagggatggatcctgaaaaagatatatctattcttgctatggatgggagactggaccaggagtggtcgattatgccatatacaatgccaggtatatgcgtgctataaaatagcccgatacctgattaacttttaccaatgcatggaatacgc

SEQ ID NO: 5592 - DNA, 237 bp, Bacillus thuringiensis
  unsure (1)...(237): unsure at all n locations
acaacctcacacgggatgcgccacnccagggtcccggatttttatccacaaagacctgcagcgtacatacgtcgtgaacatcgcacgacgcggaggataccgcatgaggctatactgagcgaatcaggtcgctgcctacgggccaggaggccactgcccgcagccctcatacataagtaccgcagcaggcggtgcaacgcctatatcaagaagctaggcggatcgcagaattgaccc

SEQ ID NO: 5593 - DNA, 220 bp, Bacillus thuringiensis
tggtgattaatttttacacgtgcatatacacgatcacacactaattttttttcatcacctgggggacgaatgtactcagagagagcccctatactaaccccagtcgctgatgcaatctctctcgctgctgcacgcggacgtcctttgcgtataaacaaccacgccaccattccaaatattttacaacgtcgtcacgcagggaatactcattcaacttaca

SEQ ID NO: 5594 - DNA, 104 bp, Bacillus thuringiensis
actctaaaccacacgtgtagagggcccggctcgcggccgatcctgcctattgtggcacctaacatgtcgcaccatgacctagcgcgggttttgctgctgcgaga

SEQ ID NO: 5595 - DNA, 119 bp, Bacillus thuringiensis
gcgacattcaattaaaactttgttttcaacacgcacctcctcctcagactagtagaactgcaaccgttaaattgtgtggagctcacgcggtcatgcataaggggaatacgacacatacg

SEQ ID NO: 5596 - DNA, 185 bp, Bacillus thuringiensis
acgtggcgcgaaaggaaggttttaaagcaaaaggagcggtctcacaagaatcattgcaccttcacttgacatgagtgacgtaactgtatgactagctattatgctgaaatatggactgtccataaactcagtcaattgaaagacagtcgtaacaatgctcgtagctggatcatgagagaaaagga

SEQ ID NO: 5597 - DNA, 227 bp, Bacillus thuringiensis
tgcagacgcctcgcgtctcgtatcatcacatacgtgagtgatatatcatcttcgtgcagaatcggtattaaagattctgttagtaggacggtaacgcgcgctaacatctatggatgagcttcatatgcctcacgaccttgtgtgtcaatataccaaactcggaatcctgcgccatagaagtccataaatgcacatgggcaaaaaaaacttgattagccactgatcgt

SEQ ID NO: 5598 - DNA, 271 bp, Bacillus thuringiensis
tcgctgctcaagctggtcgacgacaaacagcatatcagactgagcatacgctaattatagcaggactcacttatgcaggggatgacaacgaaactatcacgcatcctcttctatgatgggtgtgacggaaggggctgcctacgaaatcacactatggatactgtaacttccagaatgtataatgggatggttatatgtctagtgctgggttctgcactcggagccgcatcgtgtgaggatatgactcgctccttcaaaatggcttataacc

SEQ ID NO: 5599 - DNA, 247 bp, Bacillus thuringiensis
tgtttgcataggcaaggatttgtgcccgcagcatgtgccggctttaatcccggcgcatgctagaaaaaccaggaggaaacgggcattcccgaatagcatagctgaggcaaaccctgcttcgtagaagcagccaccctaggtacacgagtaggtctgagctagtggatacatcgtgaacgacacctcgatgcatttgatgaggcgtccctatatgatcgctaggaaattgactaacaaactaatgtag

SEQ ID NO: 5600 - DNA, 298 bp, Bacillus thuringiensis
acgtccgtataaatagcttgagtgtcttatatgtaccctattattaacaactaatcttactaatgtatatcgcctgcatctaccatttgatggcgaagagatttacggttaacatggacagatttacggctcggtatgccaacactgatgtggtgatgcatctaccaatcacgtgctggtcagtcttattctacctgcccatggatcgattgaaatcttacgcgagaactctttccaaaatcgaatagatcttttacgcctagtagggcctattcacgcagttgcagcgataacatga

SEQ ID NO: 5601 - DNA, 240 bp, Bacillus thuringiensis
tttttggggatgatagctttctttctccggagcatatacattcgttatgacgggatgctattgtgcattcaactgtatgatgggggtaaccgatgcagccccctttgggataacctgtggtgggagcttgctatatagcatgatatgcatcggtagggagatttgcgaaagcatagactgtgcgctttgagctccgcagcgagattggtctttggtgcgcgcttgttagaaaggttaatt

SEQ ID NO: 5602 - DNA, 251 bp, Bacillus thuringiensis
cggagtcattgatacctacgtttattgctagcaagccgccaactccaacatctggaaaggctgtactacctattggctctaaagcactgaaattgaaacttcttaggaacgcgtttatattttgcactaaactagcatgctgctgatgtcggatgtcttatacagtggctatactatggaaccagttgcttcactgttgtaaagtgtaaaacgatttgggatacctcacgacatacttggcttgactaatc

SEQ ID NO: 5603 - DNA, 207 bp, Bacillus thuringiensis
tgtttgaatggacctcctgtttatgtggggataatacggatattttattctgtcgccggaagatcagcatacggcgggacgaatcgctgtggctgtactaaataggattcacctcgcttggctgatatagcgcccgttatgtatgtccaactctcttgatggagtattctctaaagatacctataggcactctcagattactaggcg

SEQ ID NO: 5604 - DNA, 273 bp, Bacillus thuringiensis
ttgaccgtataaaaagcatgtgtgttttatatatacactattataaccaactaagcttactagcgtgtatggccagctataagcagttgacttacatctgtataacgtataccttggatacatgcttggatatacatgcctaaaccgatctggtgctacatctatatatcatgtgctgttctgtcgaacaccatctgcggacgagacgattgttttattatgagcgatctttttgcacatataactagagatttttgccacaggaggttctat

SEQ ID NO: 5605 - DNA, 446 bp, Bacillus thuringiensis
  unsure (1)...(446): unsure at all n locations
gcgtgggcatatttcatgatcgcttcgcggacaacgatgatggtgccttgttcaacaattaaatcgcccacgtatgagactactgaacatgtagaaatccgtaactttgcgacaatacttaagtcacacgttttatgtgtaattgcttcataatcttcacgtagaactagcacgaccattttttcctcgtctaaactaacctctcctgatatgcagaactcttgctacatgtacacgatatagcagatctacagaatagaaactctgctcttttatgcacgcgatctatgaaaaagggtggcactggttctgctgctacccccttgcntgaaatgacatccttcgtaaaaagaattactctcacactcggggtatacatgtgcgctagtgcatcacgcgatatatgctttctcatcgcatggatatgatcgctacgctgtaatatc

SEQ ID NO: 5606 - DNA, 202 bp, Bacillus thuringiensis
tatggacagcaatatatgttttatatgagaataatgatcggtcatctattgcggaaatgaccacgtgtatagaactcgcctcgatggcacgtgcctactattctattattctaaatcgggaaattggaatggagattcaagacagacgcctggtatgaatcactaacacgcccggataactctttgcgaattgaagcattac

SEQ ID NO: 5607 - DNA, 204 bp, Bacillus thuringiensis
tatatgggtggatttatcgattcggaccacctactggaatctaacaacccagaacaaagaatggtacacatgctctaaggagaagctaccataatgagtaaggatcgaagaggaccgttggccaatctggatcaacataacaacgattactcgctggacataaacctggaggaccaccctatccatctctggataaaatccggg

SEQ ID NO: 5608 - DNA, 211 bp, Bacillus thuringiensis
gtatggatgacgattataagtggcatatatgcccgagagtggatagtattcgatcaccaaatgtgtgtccctgtcaaatgcccatgatgccgacatatacttattatactcaaccaactccatatcaaatgccgcatgagataggagcgccgattggaccgtaacatacgtctatgacgaacccctatgtgaagcctctggatgataacat

SEQ ID NO: 5609 - DNA, 174 bp, Bacillus thuringiensis
catcgtgcgggaaatgctgctcgttttggtgaacttaaggcataatctgctcgctcagaatgttagggggatggatctttagacctgtatgcgcttcgtgcctctgacgaggacccgaagccaccgatcattcttatcgctggccctctttaacgcctgatcccttcatagcat

SEQ ID NO: 5610 - DNA, 176 bp, Bacillus thuringiensis
atagctccaattaatgttcccactcctccaaacattgtttattagagtgcacttagtgtcatttcaatagaggagacaaactttattggcacacgcggggtgttttaacccataaaccaccgttcattgcagcttctaattctgcgcctacacttgcgattttttttataatggag

SEQ ID NO: 5611 - DNA, 257 bp, Bacillus thuringiensis
acactgagaccaataatttattgtactcaaggtgcttttggtcaaaagaatgattgtttgctacttctacctaagacgaatgatactcctgcgcctaagaaagaagatacccgcacctactgacatgatacatgaatgagctccccctgtattcggtacatcattttctacttccacttgcggtgctctacttgacgttggcactcttactatcggtttattggggagaacttatggtttcttcagagcgttatggt

SEQ ID NO: 5612 - DNA, 121 bp, Bacillus thuringiensis
ttgtactccgctcacatgtacctgtaacgcaatgattcatgaggattttttctggaaaccgcacagacaaaatcatcatggtttattattccacggatgcgcgttaaatcgtaaacaacct

SEQ ID NO: 5613 - DNA, 147 bp, Bacillus thuringiensis
gatgtttgtataggcctgctccgcctctcattaaacgctatttttttcttgtctggctagcagtgtagctgtacgcggggacacctcaagaactgagtgagccaccgtgcttttaaacgccccttgcctattgggttctcctaaaat

SEQ ID NO: 5614 - DNA, 130 bp, Bacillus thuringiensis
ggtattaataatgtgtaatgcgttacaaataaacggttgtatgtgtcttttatggatcgttattataatgaagctgacatcaaggtatgtgaatggaatgaagtatcgcatatcaaaccaactttatacc

SEQ ID NO: 5615 - DNA, 416 bp, Bacillus thuringiensis
tacaggcttagaagggacaggtgacgccggatggcttacacaacgaaattaggcattatgcgatcgtaggcgtggtcaagccgttccatgctcgctatccgatacatgaagagattctagatagttgatgccttaccgcttactcgattggcgaatggagatcacttggttgagcaaaatatatggttccgtacatgttcggacgataacagtggcagaccatgtgaacatagctcttagagggaacgaaatggagctatggaactacttcttataaaggctgagcgcactatgacacgtacgatgaatcgattgatccattgagcgatttggagaagattgcttgtgtatcggaactacaaattcgctatctatctggggatgtgaggaatcatatcgaacggcttgttgatctg

SEQ ID NO: 5616 - DNA, 444 bp, Bacillus thuringiensis
  unsure (1)...(444): unsure at all n locations
ccgttgctgataactacacgtaccgtcttacctactatatgagtatcaagcgcaggagcactagcatcaataagatttaccggagaaatagatacgcatacttgaacatttacagacacctctggagctacgcgagacacttgacctatggtancaacagcgattgcatactctttcaccaaaacgggaacatgatccggcacttcaagatcattacctaacgaactaatagattgattatcaaccattccggaattctgctgtacggaactacataactctcgacaatctccagatacatataaagaatcgcgtaggntcagagaaaagatgcgatatccagctattgctgaacgcatctnaataaagatatgggtgaaactaccagactcatacgagaacgggtttgtgtcatcctctactaagaaatactacgcgctaata

SEQ ID NO: 5617 - DNA, 343 bp, Bacillus thuringiensis
  unsure (1)...(343): unsure at all n locations
aaacccactaccgttattatctggatgagcaaacaccatactacttgacgctaaagcgtccaaaccatatataattggctcacaagcattaactgaccctcttttataagacactccccaatctatgcctggattaagaataagtaacgcctnattatctaattgctcctatccaagccctactgcaccatctacgcgctcgcctatttgaacttccctatgacgctctcaacctataatatcattcaatcatactccgtccccttacttagacttaaaaatcattctctaaatacacaacttgtacatgtatagctttatttgacacacacatactacctac

SEQ ID NO: 5618 - DNA, 432 bp, Bacillus thuringiensis
cggatcactagatattaaatatgtgtgcagagcgaccgagcaatactaactctcaacactgctatgggcatacaccgtacagagctgattaatccgtaatccacaagactccatactgcgccctacctcatgagagttcagaccacggggaaaataatgttgacatcatacaaaaccgtattgacgccctttcaaaaaatccacttgcttcagggtatggaatgttatgatgctcctgattccattacgagaaggctttcaatcatcagggcatgtcgcgcatctgctgaaaccgcaaggcggcttccaacattgactattgaacacaggatctctctcttgaactgccacgtcacctggcgcgatacttacaatcataaaaacggcgagctctattacatgcatagatgccagaattatttagcctcactt

SEQ ID NO: 5619 - DNA, 183 bp, Bacillus thuringiensis
cgtgatgggtggttccgcatccggagcagctgggactaaaacaagagtttttcttgctggtaagtcgaaagcgtcattacgagacgcgattccaagaagaacggggtttgcgttaacaaaacgtactccaagtgcacgaggatgcgcaataatcaccaccccctggctgatagttagccaccc

SEQ ID NO: 5620 - DNA, 334 bp, Bacillus thuringiensis
ccatatgttcctgctcaaatggcgcataacctacatcactctcttcatcactaacccaaggagcactagaaaatgtgccttactaacttgcgcatcagactctacctctatacccttacggaatatgccattccaaatctacggggggaacattcggactgtactacgatacatcagctccgcactctgaagcactctggtgaaaggatgtccatcctttccacgcatttaatggtgcgcccctagcacgagaatgggtacaaacactatccactccttgctctttcgctcataccaacaacgtgcgctaacgacttgagcccattgccagagg

SEQ ID NO: 5621 - DNA, 183 bp, Bacillus thuringiensis
ggccgagccataccaggggtccggcagggaggtgccaggggtgcatttggggtcgtagtcgcggatgagacggaggttgtcggcgtcgggggccatccgcttcatcatctggatgtggcgtggctcggcggctatgacgaggtcggcggacatgatctcggactcgtcgatctggtgagcgtt

SEQ ID NO: 5622 - DNA, 268 bp, Bacillus thuringiensis
gtatagcttacctctggtctaggatctagacgcctgacgacagaattcacatatactgcagatgttttaggcttccctatttaacttagaggcagaaggatatatctattcacctattggacaccctactgtagccacatttgaacaggccgtgttgctggcgtaatgccataggctacgccccgctgacgagcatgacaaaaaaccactcttaagtcaaatgtggaaaaaccgtaccggactataatattacctcccgtcttcccct

SEQ ID NO: 5623 - DNA, 304 bp, Bacillus thuringiensis
agctctagatgctcgcccacgactacaaattcatatggttcatactcattaggtactctaaagtcatagataacacatgcatacttatagtcagccttttgtactgcctgacacgttgacttatagcctttcctatacgctgtatcatatgccttcacgtatactcatttctctgtattatcaggattctcttgatcttgtttttcccctgtctctgccgcctaatccggcgtggtctctttcgacgtattcagtgcacacaatactcactacgtagaaacctgaatgcaaggttaagcttcaa

SEQ ID NO: 5624 - DNA, 112 bp, Bacillus thuringiensis
gtaagagatactttttcatatactattgccgaccaaaaaacaggaaacgttccggtaacaaatgtgttatcttcaagacactatttctgtccgcatgcgttccttttcttgc

SEQ ID NO: 5625 - DNA, 226 bp, Bacillus thuringiensis
gaatgcagatcatcaagtggacgtttgcttatctagcagcaacgcatcaccaccattacggatcattcgagtattcgtcctttctaaacgtgaggctagcaatgcttttatctgatgtatacgaacaatatatctcttggaatgagcggcctgtgcttgttcatgtagatcaacatcaatcaatatgttcagtacaatggagtttatatgccgacattcacgtcga

SEQ ID NO: 5626 - DNA, 207 bp, Bacillus thuringiensis
ccgctgccgatcttcactttttactaagtcttcaatttgctcggtcgcctcatctaatatgatttcttaacatctccttctgattaaaatcactcataccaaatggcgctaagatgcattaaaataaacatcaggaacgacatctatctaaactaagacgctgttatatagattcataatttagcaaatagaaaatgctctcaagca

SEQ ID NO: 5627 - DNA, 222 bp, Bacillus thuringiensis
cgcatctgaccagaatcggatcggattggcaaaagatgctctaggaagaagaacattgattttcttttccgatgaactggcttttcggcccgcagcggaggaatatcggctaattcggggaaacgaactacagtctcctcaattgcaagcttgtaaacaatcgagccggcatccaagctcataaaaaagcggattcatgtcttgccttaccggacgaaagtg

SEQ ID NO: 5628 - DNA, 407 bp, Bacillus thuringiensis
gcttaataggctgtattctatttaccatcttggcccctactaccttaagcgctcgcataatccaacctgcgggacgggattacaagactggaccaaacaccattcgaccgtctaataaacatgctcactcccgaactctatatgcttaggaaatatgactactatttaacatccgttatgacttatgcgcaacctgaagcgcgagagcttcttgaggcgccgtacataggatagcacagaccacacgcccgctctcatctccaacgaatagattagcacaaatcagcgcgtatatcaattggaagacacctgtgtgcatgcatacatagagcggcgggcccaagcctgtcaacaattgccctaatacgaacgatacttgcaccgtatccgcacaaaaccagtgcatt

SEQ ID NO: 5629 - DNA, 314 bp, Bacillus thuringiensis
ttacataagagctctaaccgctgaccgatatactctcacctatggcaacattagattgaacaatctttgcatgaataggagctgcctgtccattctccacgctgttgcatgtacgctgtgagtcctaattctcctacacttgctgtcaacattttaaatcctccatttgggcattcgcaacgatacgtatatcagaaccaacactgtaacatactgatcgaatttgcaaggaaagcgcctctccgcgataaatgaaaatccatactcctgcaaatacaacgatgactcctcatttcccacgcaattgaattctc

SEQ ID NO: 5630 - DNA, 209 bp, Bacillus thuringiensis
aggatctagcatgaaccactcttcctcggcctctgtttttgtttatatcgagccagggggaacccagactgggaggaaaccaagaacaccgctatcggggggtacaccacagagcaaccatttgcgggaaccgaccccaatctaccgggcccgggataccactaaaagccaaacaacggctgcccgccaatggacatcctacacccgac

SEQ ID NO: 5631 - DNA, 245 bp, Bacillus thuringiensis
cacaccaacagcattgggacttacacctttatgaatctactttataacttctgcttttgcagcttctttggtgtgaggacagaccgcaacctggaaaacctgccaaattactaataaccactaagagcgacatgtacaaagattgctcatcctgatgaacaaaaggtccaacgaagcgtacatatcctaggctgaacccatgaaaaataaacgccataccaacagagagcaccaccaagaagacc

SEQ ID NO: 5632 - DNA, 149 bp, Bacillus thuringiensis
atgtagatcaaaggactacaaaatctaaacgacctgaactaggacgggtaaacttgccggagaaagatatcggaaggatactctccatcatcgagggggtaagaagagctattacggaacatttggaagagacggtcgatgtaaattcg

SEQ ID NO: 5633 - DNA, 243 bp, Bacillus thuringiensis
ggtcgaaccataccatgggttcgcgagggatgcgccaggggtgcatatgatgtatggacagcgcatcacacggtggctgtcggagtagggggccatccgctaaatcatctgtgagtgaaacgctactgcagctataacaaggtcggtatacatgatgtctgactccactgtctggcgaacgatatcaccaatgcttgatcctataccaaacccgtatgaagaatggctagctccgaacttacc

SEQ ID NO: 5634 - DNA, 109 bp, Bacillus thuringiensis
acttgaataaatgaattgttctattaacgttgagagcgttgttgattcatgacctctatgtcgcattctctttcacgtactcgaagggttgctactagctgatgaccct

SEQ ID NO: 5635 - DNA, 476 bp, Bacillus thuringiensis
  unsure (1)...(476): unsure at all n locations
cagatcctgggaatagagatgcctttacgtatactaagaaaggaaagctcaaatctgtactatgaatgccatcatcactcatcgatttggcacaccgtttctgaaacacaagctatgagaatcccgaaatcactgattcacagaatgcggtcctcatatgatctacccaagtctacatatagacagagcctacacaggaacgtccgcaggtatgaaatactctgggagtaacaactggcggaatcgatccatctcgatgcggcacaatgccatgtgccaagctagccgtattctacgctcagtaagagctcgaactagtcgtagtgttcattcatgagagtgtcgaagggtctttatttaacggatgtatacagcatacgacacatgagcataatatggaaactgtgataacccaaatgacngaacctgctcggcttatgggcatgcctcgcactttccgctatgcagtgggtcca

SEQ ID NO: 5636 - DNA, 444 bp, Bacillus thuringiensis
gcctccaacgaatgaatggttttatatagatgcttggattgttccagcccttcttacaggatttgtccagcggcaattaactcatggtgaggcagttggttctcgtcctacaataacgtattgaccgtgcatgcgctcgcccggtcatttagattactcacgccacattgtagaccaattacggaccggggagccaattggctgagacgttgtcagtaaacatcgaccctcaacctaggccggataatcgccagctgtcggagttactcaaagagatgtagcatatgttatctcagaagtacgttgatacgccgctgtcctactctgtgagaaagcctttcttatatttgacatggaactctctataggagatgattgtgtgtcactactggatactatgccaccggcagtggtatcacaagcgacaacgaaagatgaataggc

SEQ ID NO: 5637 - DNA, 190 bp, Bacillus thuringiensis
atacgctcgtataaaaacgatatacaagtgcccgtttgatcatcattattttatggcacagatcgatctaacttctgactgaacgattcatatagaattaataaattatatgtcgggctcaccgatgatatgcgactcactgcgagaacgccgcccttaatatgagcctccttcccattatactcttact

SEQ ID NO: 5638 - DNA, 245 bp, Bacillus thuringiensis
tgctccatcttattgagcgggttggtgcagcttgatatggattggtcttttaccaggggtaacacctgtaaattactaacagggcactttaggcttataggggcgatttcattgaatccttgatttaatcttgcccagaggaagctgtgaatgcagcgagtgtggaggaattggcaaagataatatgtaggccaatggctgtttgcttttatcgtattatgatggcgagatatatacaatttagc

SEQ ID NO: 5639 - DNA, 350 bp, Bacillus thuringiensis
gctgcactcgcgggacccatcagatccagaacgcatgatcaaccgcgcgagcgaagggggaaccctgaccactgtttggacgatctgaatgtgccagtcattgatggagtggggcatatgctcaaacttgcggaggagatgcatgggagagagggccacctattacaaagaacgcgacgctattaattttagaagggagtggatcgtatgacgaagcctaaaaaaggggatctccctatctcccctatcataagtgaccttgaccattatttaaaacagacactgggactgcgcgtcacatacgaagtgggcattcggaaatttcaaattttgaataaacaaattggtgt

SEQ ID NO: 5640 - DNA, 428 bp, Bacillus thuringiensis
actcgatagtagcctatgttatatcactgggcagaatgagtgtccaagctcaaagcataacatccttcatactcacggagctcattacccgattaccggcgatcggactaattcaatgtttagtaacagcattcggtgatgcttgccagattcatcgccatcatcacatataattgatgtcttttacaccgagctgccggaacagtcgcgctagaattgattccggagatatatcctcacttacacgctcggttaccggcgacatactctgaatcaggattgaacgcggatttataagatcgagagctccgattcctgtgggagctcatcggattacatcatgcgcccctaatcgttgtgttagaaaagggaactacacaattctttcactttaatgcccaaactttaaatggaacttgaaacttggg

SEQ ID NO: 5641 - DNA, 186 bp, Bacillus thuringiensis
cgctgctttccgttttactcagcaaatatgaaattttagcggcaacgtggatgaatggcaatcacaccatatttactctagccgacatagcggcgctggaaacagcattatatatgtatcgcctatacttactagtctgtactggagaaacgaacaccaaggacgaagtgcatgagtcgcctcgcg

SEQ ID NO: 5642 - DNA, 267 bp, Bacillus thuringiensis
cttcggatgaactacccaaagctctagaggcaccccctaataaaaacgtgaatcctgatccatctatctccaaacggcggccaagcgaacatgccacgcacaatatggcattactaacagatttgcattccgattggccagagggaattgaaaacgggccaattcccgatatgtatgcggttaccccagaggacgttcaacttatgctttaaccggcggccctcaagaggcaaaatcacctaggaattattgggattacccgagcac

SEQ ID NO: 5643 - DNA, 439 bp, Bacillus thuringiensis
tgtaatggatgattgttattaacgactatacttgaccgagaagggggattgcctttataattagttacagcttgatgattaaagataagaatattttgctgcttgaagctaactgcatgtcgtttgctcgaatgatcatgagctgcgactttatttctctgctgcgacatgctcgataacgggattaggaggctcggatttatacggaatcacataatctctataaatatcattatggaactgcaacgcgacgcgcttcttcttgttgctgacagggtattgatcaacagcgtctcctgttacaagcggacgttattcatgatatgacgcgctactgacaacaatagaactcgcatctagatcgcgcgtatcagtcaagctatcatgcacaaatcgcatatagctgtttgaccgatgtatgatcaccatggcatgaaat

SEQ ID NO: 5644 - DNA, 120 bp, Bacillus thuringiensis
gctagcccacgctcaagcagcatgagcacgacaaccaattccactagagatccatggcataaactgcaatgcacggaccaacaggtctaccaaaggcgagaggaaaaaagggccgacacc

SEQ ID NO: 5645 - DNA, 189 bp, Bacillus thuringiensis
tggtcaaaaacaacgccaatagtgctcacgaatcctttttgtagtctatgcgggctgattccatagactggggcgctcgctgatgatcgaaagaacatgcccgtatgcctgctcatagaggttgagatacctggaccgttataaccaatataaccggccattcgcccgtgctttacacgcaaagagaca

SEQ ID NO: 5646 - DNA, 196 bp, Bacillus thuringiensis
ctcgagactcgtgacacaaacacatataccgagaggagttatgtttctttccattacaaaaacaactggattgtgggaaatgcagagttcattgcacgtctatgattatggcttggtattccaatcaataatttcctaattgcaagatattctcccctataataacatcaaatctgttatattatttatcggacta

SEQ ID NO: 5647 - DNA, 271 bp, Bacillus thuringiensis
actctagaatcacttgtagatgctgcaggggggagaattatatagaatatctcatctgatcacttaccattcacataaccttctattattggcatttctaaagatatatgataatatcagtgttttacatcaaaaacattacgattacagcacgttccagctagttaacccaatcgctcttattcccctcgaccaaaggaacaggagaacttatattacatgggctatgtcatggattggactccataattttaggacttggcggaagttc

SEQ ID NO: 5648 - DNA, 152 bp, Bacillus thuringiensis
tgaccaaactcaaccactacaatcaccatgactcctatttttattctatgctaattgatttaaaacactggggcgattgctaataaacgaacaaccaacctcgaatcaccgctcatacagcatgatacactattctagtgcgccactataat

SEQ ID NO: 5649 - DNA, 157 bp, Bacillus thuringiensis
gaatggaactaaattcagggatgatctctctggatgcaattgtttcaaaggacccggagtcctatgagaactggggtctttgtgatatcctaagaaagattgctaatgctctgactggcctcccgtgcatacctaccggtccagcgtgacgaggtgg

SEQ ID NO: 5650 - DNA, 286 bp, Bacillus thuringiensis
cttgttgccgctctacatttgttcgaagttcaaaggcctgttcatctgggtcaagggcgtataggctcactaacgaagttactgcctgtggcactcgtgctgaacatccttatggctcactgaggggggctaactgcacaggagaagatgcaccatattgtatggttactacagcacatagcgttaccatgcacacagcgctctcaccgttaacatgttgactatatcacgtcatcatgacttcattgcgccagatcatttcatatcaataacgcatacgatatcg

SEQ ID NO: 5651 - DNA, 128 bp, Bacillus thuringiensis
  unsure (1)...(128): unsure at all n locations
aatatcgatgcattctcatnaggagaatgaaagaaagtttctatatataattagcccgaaagatgcacctgagggcatttttaagaattccaggagcggacaacacattatttgataacccttgaaaa

SEQ ID NO: 5652 - DNA, 403 bp, Bacillus thuringiensis
gtcattatccggtatggttggtggagtatgaacacacccgcattcttgaggcactggcggcgctccactcatagtgcctacgatgattcaggacttcactagagctggacgtacactctgcttatgctataacaaaccttctggtggaccaatcgatctacacctaggaaatacagacatggtgatgtgggcgaactgatgattgtaacgggcacattatcacacgataaagggagaaccccactatatatgccggctaatctcacagtcctcctgattttatgaagactaaccagatccttcatgagtcatgagatccgcttaccacatgtcagtatcattgctttgattaaatggatttttcagttgcagttgttccgaaaaaccaactttcttcctgcat

SEQ ID NO: 5653 - DNA, 171 bp, Bacillus thuringiensis
cactgggacacttccactgttttcatgcgatcctgtagcattgggtgaggacatttgaacatagggcgaaggctttggaacataaggttcattaccatctagcagtataaaattaattaaagaaacaggagacaggacacttgtatatgcaagaaactgctaatgacgtga

SEQ ID NO: 5654 - DNA, 194 bp, Bacillus thuringiensis
catacacgttaagtttcttagaaacttgacggcctaagcttttctttggaagcatgcgtaggattacaagctagggcaaatgaactggccttaggagtattcctttccgcaatgtatcttagctatacatccaccctgggaagataggagctctatctgtaaggatattttggtgcttttgaaaagactttatg

SEQ ID NO: 5655 - DNA, 267 bp, Bacillus thuringiensis
gatggatggtaataactaaacacttctttcaccttgaagttatcttaccctcgataatgaccgttctccaagggggcatatactgtccgctaagcgcagcgtaatctttgaaggtacataatacaccatcgaagtgtaattctactaatgacggtctacaccaatcacgttcatacttcctgtgcgagctggctcactacaggttttacagaatacaaaccttattgggcatgaatgctcatttttgccactcgggttaaaaaaaat

SEQ ID NO: 5656 - DNA, 167 bp, Bacillus thuringiensis
cgtgattaaataaaaacgtaaaagaggacacacctcaatcacccccctcctcacaccgacttataaaacatcagaatttgcgggtatattcatggaaaacatgcggcagcctccccatattctcaaggggcacagtcaaaaacaacagaccactctgactacttccc

SEQ ID NO: 5657 - DNA, 200 bp, Bacillus thuringiensis
tcccacttcgtgatagaccatgccgtctaatgtacatagaacaaccagctccaggctaatccatagcccgtggggtgcctcgcgggggggaataaaagccacaaggaacccacaatgcaccaatgtcaacaataactcccaaacaacctaagaccggagctatatctgtatggaaacctcggttcaaaagtaaacgacct

SEQ ID NO: 5658 - DNA, 197 bp, Bacillus thuringiensis
aattaatataatttcccgcaacccatgattttcagccttatgaaaaacttattgtgcgggggtttagggataggttccaaagtaggattcacatttgaagaaatcgtgcatggttattacaaaaagaatgtaaattaaccaccaactccaggatgaccgttatttaagactaaatttgaatttctattagaaaagga

SEQ ID NO: 5659 - DNA, 179 bp, Bacillus thuringiensis
tatattgaagcgtacttttttttttttttattgtgcaaaacgcattatgtatgctgggctgagcaaaccttataacaaagacgcccactctatattgtctccaaacaatatattctcttcgggattagcgtgctgctcctttcatgcttacgggaccacatgcatgacttttaattaat

SEQ ID NO: 5660 - DNA, 119 bp, Bacillus thuringiensis
ctgtcgcatcttcttcataaggcctcctaatatcacggcgctattttttctttatgaatagggaatccttctttaactagtgggtgaatcgcgacaccatatagacccgttgcacggtc

SEQ ID NO: 5661 - DNA, 136 bp, Bacillus thuringiensis
gtactcgcgtaagtttttttttaaatcgaccggtaccgctcattatatttggattgctaacctgtccatacataacggctaacgagactgacgacattacatttatcggtccaacagccaggactcctgcataggc

SEQ ID NO: 5662 - DNA, 495 bp, Bacillus thuringiensis
gacgaagcgataaaatccattcaaccagcacctgagtcagatgcgagtaaggattatgtaattgcttcggaagagcatactcaccgatcagcgataagagcagcttgaacaccaaataatattgtcggatctgacagtgaccaattaactactgatcgaattacggttcctactgacgggctcaatgagccacatgggaaccatgcggtttgccctatggactcaactactgaacttggttcaccatcaagctgctatcatatccgtgacgtgtaaatctaaccaacccagccccatttcttaacacccatattctcgtatcaccaacaattctcgttactgatcatcgctactgctgctgtcaacatggagatttacataggaatcattattgatctactcataagataccaacgagaaacatttatggtactcttctcttgctattaaacatcgtaacgattgatggtggacatgcctataatatgtatatac

SEQ ID NO: 5663 - DNA, 253 bp, Bacillus thuringiensis
taaagcggaagcaaggacggctggattgctgaaactaactgtggcgaccattgcaaaaactgcgcctgtgcctgtgccggcacctagtgagaaccaaaatcttctccatgccatccatggatgactgatccgcaaatactacacactccatactatccaccattgaaaggagatgggaaataacttgtcgattataatgtatgagagtctgttatcacagaaaccgattcagctcttgatggagcgcccaatg

SEQ ID NO: 5664 - DNA, 145 bp, Bacillus thuringiensis
tgagagtggtcccagtgacaaggcttcatgagcctaagcgagcatttttttttacgtgggggggccagaacctcctcagtgaggacagaaatgtcactctatatacatatcacaccacggatagatatactagtgaaatatttaa

SEQ ID NO: 5665 - DNA, 284 bp, Bacillus thuringiensis
cgacctatgacggaggcgttcccgtacgcgaatgcaggacgcttggtaccgaccggaacatctctcgagcctatttagagctaggcttaagaatgataatggatgttgcctgtgtgagactgttggccaataacagagccgctcaacctacaatccagcgccatttagagcaaagtctgagcggtcacaagagcgatctgacatacatgctgcgcatctggcggaatgggcgatcggcgcgggcctatcctgtattgccccatgtggcaatgggtggatctgct

SEQ ID NO: 5666 - DNA, 557 bp, Bacillus thuringiensis
cacgaggagtggatcagatcctataacgcgttagcagatgcttggtaccgtactttgcctgggtagagaagtatatgcgctagctgccacattggagatagttatataactgtgtgcataatgcgatttctatcacaaattcacacaacacacataccggattcatttatagtccacattgaggtgcctaacgagcgatctaacttacataaattgcatacacctcactgctctctcaccattatggacacctggcttgccatctgcaataatgaatcggagaacgtccgacgcagaggcggcattgcgttatccggagcgctatatccgaatgatttaaaactgactctatgcgctaccactttctggagttgtgatcgacctacggttactgaatggtggaaaacagacctctcacatatccggtgaaacgccgaacgtataagcgttctgaaggtcaatgaaaggccgtgagaccaatgcgggtattgaagctggtgtcatgatataggctacggctccactacgagcggaacaggatctgacattcatactaa

SEQ ID NO: 5667 - DNA, 148 bp, Bacillus thuringiensis
catagtgatggatggctaatggatataagtagccgagacattatgataaagtttgtgttaagatgatgtataatcgcctcacttattagccagtgagccgaaatctgctacatcactcatcagtcaatagcactgaccgagatatgcg

SEQ ID NO: 5668 - DNA, 121 bp, Bacillus thuringiensis
tatgtgtcggatccagagtgagtgatacagtttagagtgtcatgcatgacataaattatgcagtttttttttctgataaaatttgtgctatgaaaaatggacgggttgctgctttgggaac

SEQ ID NO: 5669 - DNA, 618 bp, Bacillus thuringiensis
ctgagttcttctacaagctaaattagcctgggctaactattctacttcacggaagggggcctccatctcgctaaacgctggatgactatgaatgtcacctaactagccgcacaatggacttggccgtctacgtaccacttcttgactgaacaaaccctatcatatccctacttattcgtctactatcatattccaacatgcgacagctgacgttctatctaagatgcacctacagttcgctctttccaacatactgcggcgaacctcattggaaaatagcgtcttgtaatgcataaatatatatgataaagaatcgcgataaaatttgagataacttaggtcatttattgacctatacggctaattatggaggaactctatttgtgcagaaaaatataccgatatccgatatgatgaaaatgcaatatggcgcaatagtcctctataaaaaaacgttgtcctcaacggagtagggcgaatgactcattatcacggcaaaggcacaccacaacaaacatcaccataatcaagtcatatgaggccgatgtgccaagaatcacctctatcgaaaccctacagggagccggcttatattatcctggctgtgcatgccttcca

SEQ ID NO: 5670 - DNA, 122 bp, Bacillus thuringiensis
gcttgaccaatcactggttttagcaggggtaggtgcgcgacttattcaggaaggtataacctcacaatataagcgcttacaacgacataatggattatcagaagaggttgtagaatatcatc

SEQ ID NO: 5671 - DNA, 149 bp, Bacillus thuringiensis
taaagcgctcagcctaccatacaggatattattgctaccagtatatcacacgcacgctccctctatctaccacaccggggtttgctaataaatctttcgctctatttgttatcgtactgatagccacgtatatccttagcataatacat

SEQ ID NO: 5672 - DNA, 206 bp, Bacillus thuringiensis
  unsure (1)...(206): unsure at all n locations
caaatcacanaacggaaggggtaaaagggggccttacggaaaaacacggggaggaaagcaaagagcaccacgaaaagagcaccggaaggaacgacaacggatactaaaaagaaaggacgcaataaagaaggtgaagcgcagcgcaataaaggaagggtcgtagacataaaggggaaggaaacgagggtcgtcatccaagtacaagg

SEQ ID NO: 5673 - DNA, 220 bp, Bacillus thuringiensis
ggaattctgactttgttcttatacagaatgcccacagattatgtgggctcggaatgttgggcacgcgtatgcgaccacatagaccctcgtatggtattaattcggcttacactaatcggggtattgctcgttcaagaagtataccataatgcggcccatgtcttgagcttaataacagatgcttgatcacacgaggaaaaagcattctttcccataggtt

SEQ ID NO: 5674 - DNA, 515 bp, Bacillus thuringiensis
ctcgatccatattatccagtatatacgaggtaacaattttcgcatcatattagtggtaccgtagcatttgcagataactatcgtcaatagcgtgttgtcttccagtagaaagagaccatataactatgatataatgtaacgcatggttatgaaaaacctaggtcggaagatgagtactaaaatgacgccaccagttgcgaagcaacgagttaatagatgtagaatgtgaagatccaacacctgatggtgccggtggagcgaaagggaagggctatcctattttcgggaaaagcggatcaccaggtgaagaagcgcacttgtaaatcattaacgtgatgaacgacttcgcatgtggtcggttaatgaagcttcatacagaatgaccatataggagagacgcagaatgcccagtatattatcagagcggcggttgatagcttcagcgcttgccttatgacggacacttccgggcgaacgaaaaccaagtacgtgacggtatgcattgtataggacga

SEQ ID NO: 5675 - DNA, 216 bp, Bacillus thuringiensis
catctattccggacattttccacatcaattccgttgtctggtggggacgtaggactccctatactgaggtactcttgaactgggctgactacctgtcctgcaaatgtacaagcctggaggaatatacctcccagacttcactccactttctagcggttgtctttacactaccggcctgcatttggaattgcgtcgggcaaccgggcgtgccatgcg

SEQ ID NO: 5676 - DNA, 246 bp, Bacillus thuringiensis
ctggatgggaaggaatctttcaattgtgtactaccttttttaaccacacaccctgggactctaactgggggtgagaccgaacaatattggctgctatagagcttgacttaccaatggggaattgctaccggcgtcaaacctgggaaaaccttgccataacgtatccttttcgaacggcaacacatgccccttgatcaagcttgcatattagctaaaaggcacatgccaatcaaccttcgaaacagg

SEQ ID NO: 5677 - DNA, 254 bp, Bacillus thuringiensis
gcgcatatcgatatcgttctcagcagaaatcgtgacttctgtgccaactgtgtattcctatagtcgcaagtgctttatcccccacaggatgatttacttgctcccctttggcccatagattctttttattttttatcttattttcattttatagagtattttatctgttttcctgtttcgttttttctatcttctgtttagcattatcttctcttttctttatttgccttaagtataagggtaaattttcttaa

SEQ ID NO: 5678 - DNA, 227 bp, Bacillus thuringiensis
cggtatactacacagcgttctcaatcatactaacacacattaaatggtcctacatgtaacctacggtcgacccctggctcatatctgggcacttgccccataatttggccaatctgatcaacttgagggccgctactatcgtttgcctctaccaattcgttggcggactctgttcctatatatttgcgcttctatggctcacctagcgtataccatatgagggcttg

SEQ ID NO: 5679 - DNA, 236 bp, Bacillus thuringiensis
caacggatcattctgtttatataaccacagcgccaaacgtttctgttcaaagtggcgttacagaccgaattggtcaagatcgtgatgtaagtgcacggacagcgcttgcggttatgaacatgacctacttcttccgcgactttgttcatacgatgcaagaacatcgatggtctatgacgttgcttttactcttcatatggaatgtcggcatgattttaattctagtcatgtaaaat

SEQ ID NO: 5680 - DNA, 374 bp, Bacillus thuringiensis
gatatgcagcctgttttcattgagcagagtttggggttaccattgggccgacatattgatgcctttggacggatggaatgcgctgccccatctgaactcattatattgtcagatctaccagacgttgctatgaaattggcctatgaagtgggtgatctggtcatactgcaccgagagattgggatgcaagatacataaaatgctgtgagtggagaggaaaatacattcccggcgaaagagagcatatgatgcgacttgcgcttgacggctgtgccccaggggatcatcgagggtgtggcttgagcgataccggatcgataatgtcgtgcgccgcatcgtgtaaccatcgatcctatgtattacgctggcagtgg

SEQ ID NO: 5681 - DNA, 228 bp, Bacillus thuringiensis
tgcctgcttcttcgattttttttcttcctcaaagacagacacttgcgagggttatcctatctgcactatcggattctgtatctctgctataacatatatgacaactacatggaccggagtaactacttgtacatacacttctactcagtacggaataataatatgtaactggacttctagctgagctaacacttcgttcatcacgagcgaatacgctacctggaagct

SEQ ID NO: 5682 - DNA, 257 bp, Bacillus thuringiensis
atgttctcgattcctgcctttttgtctgctaaggaagggattgcgccaggaagtaactactgaagaatatgactgcttgattgtatctccagcttctgtcgaaagcgatacaacagagaggtacgggtatgatgcgtttcttcatcatgtggtagccatgtagctagtgcttatagtcgcatttattgcgggagctgtcacaggatccactgttcgggttgttacacgactaagtctaagtgtatctcatgtgtcca

SEQ ID NO: 5683 - DNA, 144 bp, Bacillus thuringiensis
tatgtcgactacgctatgattttttgggagtacggaaagcctatcatcctggagttcttaccgccaatgatgcctgttcaagtgtcttcatctcagacgaatgcgcaattatataatgccgatgtacttggactgcgtgtctct

SEQ ID NO: 5684 - DNA, 212 bp, Bacillus thuringiensis
cccattgtcaagaaaagatgtccgatccaactattatatttttcgtcttgagttacacgctattgaagcgcgacctttcctcaaagcaacttgataatcatacgaacctcattgttgcggacgctttccgaactcaggcgcgttaacaagatgtgctggaactatataatatgtattccgataaatatcgactggggagggttgatactgac

SEQ ID NO: 5685 - DNA, 528 bp, Bacillus thuringiensis
cccccccccgggggtttaaaacttcccctggcctgaaaagcttggcccccaattcaaattttaacccccattggaaaacccttttttttaaagcccaatggtcccggggcgccttggcctgccttttatggaaaacccttccccgggagggttcccattggtggttaaaggcaccaaggggctggaatcgggccctcaaaaaattttaccgggggtgccaaaaaacccccctttggttaaggggtgaccaaacccccctttcccgggaacgggaaaattgtttgccacatttggggcccttttgtgggggggggaaggtttggggttcccctccgtggggaggtgaaggaaaataacctccagggtttttttccccgcaaggattcccttggggcccggaattggtttcccgggcgcccacaggtgggaaaccccttggattttttggaaccgatccttttttgacccccaaaaaacccaaaaatggcccttttttttaattttggggggccccccaaatggccaacc

SEQ ID NO: 5686 - DNA, 293 bp, Bacillus thuringiensis
cggcccccacgcgtggtctacagctcgcctactgctctcgaagctcgtggacgacaaacacatatgagtggctactcgccctaggatatcgcatccagtctgacaagtagaacatgcttatgagggatagcgcacggctatacgtcaaccatattgacagacctatacggtgagacagcccttgatcacttcctgcatatgcgaagcccacacttatcagactgatcaacggttccgaataaccataagaactgaactcgttgatcggtgccatttgcacatcacgaatcagg

SEQ ID NO: 5687 - DNA, 278 bp, Bacillus thuringiensis
tatcattgctaaaggtatttaaacgcgagatatagctacgaacgtaattggaggagaggcattaagtaccggctttattaagcatgctacggggtgctcggaaatagcaccctgaaaattaaacgaaaaactagattaaaaagcgggatacatcactgaatggacagtgctacaaggatattatcttccattataccagagcgactagagaattcggaccattgtacactctgccaaaggcaaaaagtcttaaatgtgtatactgtgcaatgaaaggc

SEQ ID NO: 5688 - DNA, 296 bp, Bacillus thuringiensis
tatcgtaccagttcctttccatgcggctatcactagcgtcccattttatagagtctttccgaataatgcgaatgtgactgctgatttccacgtttgtcctctccatccaccaattacaatcgttgccagtagtaatattggcgtgactcgggtgaatgtaagatcaatttatgctataaaaagtgataatacgccacacgcctgagtctgagataccttcacgcgttcgaatcttattcctaacccatgaactgtccctggaacgagtattatttttcaagaacctatcccctctg

SEQ ID NO: 5689 - DNA, 254 bp, Bacillus thuringiensis
ctagatctgctagtactttcattacataacctacccgtgttttttaagtgctaggaccaccactaactctacgggagtacacatttactgtatagttaacattggctgaatgtacttcttgcacgtgataattcgcatcgtcgaacgaagaacctggcttataaaataacaccggatacgaagtctatactgaacatgacaatcttgaccattacgggtaagtttcacccaaccctgttcttgatcgaaatcga

SEQ ID NO: 5690 - DNA, 289 bp, Bacillus thuringiensis
ccctatatgggcaccattaacataactcatgagaatatcgagtgtatccaatctgaatccacacttaggcctcgaagtagagaggctaaatgctcaatgccaatgaatggctcccatcatcttatacatatagctcccggccgccctatcaccccgcatgacgctattgaagacactgtgtcctgcaccttgctggaacacagccaagaaacttggatgtggcgaatctaatgctagatgacaatcttcattatctccagctcctggtttaattacttcagttagccac

SEQ ID NO: 5691 - DNA, 197 bp, Bacillus thuringiensis
agcatcaaacttttttttttgcaggacaggaatgtgacagtagtcagtacaccaatgagcggatttggagagcaagtcgcggtttaaataaacggtaatgttgatcgtgtggatactaactttactgaaaagattagaatgattatttttagaaagatacccatacggattgaggcgagaagctagtcaaaatcgcg

SEQ ID NO: 5692 - DNA, 425 bp, Bacillus thuringiensis
aacagggctcgcacattttttggctcttttaataacgcggactgtactgaggcgacagtgatgtacgtaccggtggagaggattttaatgctcattgcagtacatagcaaatttatggaatacgcttactgcttgccaaaattccacaacctacttagcgtgatttcaagtattactggcctattcatttcacgcctatttaattaccgatttccccgtcacatagggggcctataccacaatgactgacggaaaggaaggtcttcctaaatggaaaactctttttatagcccaggtatcgaccgtaatatgctcattggactaacggatggactatgtatgttctatatcttttacgctggattttagcgagaacacaggttcgaagataccgatagaatgaataaaagatatgctttgatact

SEQ ID NO: 5693 - DNA, 144 bp, Bacillus thuringiensis
aaggggggccatccaaaaatcggtaaggaacttggaggaacattggccaagaaaaacaaaatatggttttcacagcaccacaagggcccgggggggaacggtttacctggccccgagtaccgggaaccgggttaaaaaatggtg

SEQ ID NO: 5694 - DNA, 224 bp, Bacillus thuringiensis
gctttcgagcggggactccactcgtggggacatatgaccgatgcccaagaccaacaaatgccagatttgtgccgtcataccgcttatgacctttctacatgcatgacatgagccgtaggctgcaactgacgctcacacatgaccagcgcgcatgactttattgtacctggcccgttgactcgcgcgcgctacttcaagtgctgtacctgctgtgccaggcactg

SEQ ID NO: 5695 - DNA, 436 bp, Bacillus thuringiensis
actattacattaatactacaaggacatacggttgcctatgtataaagtgtacatgcaacctctgaattaccggactatgcacgaggtctgactaaacagccgtaaagttcgaaatatggagcgcctatatggataaggccatacttaaaatcgttatgctacccaaaacattaagcattaggactcacatggctggccacggtgtgtgtgcttacaatgagcgttagtatgccttcgctctttggtagacatataacagcacataggactgttcatatgggatgcggtgaaagaagtaggaatatacccggggctgttttgattggactttgtcgcatctgtgcacgaataacagttcgaggacgagcgcactccagccaggtccatgtctcgtcgactacagatgtatataccgcctgtcgcccacttactgatg

SEQ ID NO: 5696 - DNA, 403 bp, Bacillus thuringiensis
tatcactattcccgatcttcctggagaccgtcctttttttagcattatttattaggctcgcgagcggtatgatgattcgaacgcgagatgatgccacgcaaaatgggtgcagaggtcagcgcggaccgttgcatacttgctctcttttaagatgacattcactagtgtctgcatcacagatgaaggccactgtttgccgagcagcatgaccctaacctaaacactctgcgatggcaaacgaagttggggctgggacgatgcagcgatagaggccctcactctatctatcgggagacatttagccctagataaagtagatacgcctattgacttaccagaaatgacacgtacgcaatacctcatcatatacatatgtatcacatgctatgctgatggtggaaca

SEQ ID NO: 5697 - DNA, 482 bp, Bacillus thuringiensis
  unsure (1)...(482): unsure at all n locations
tgaattgttgggttaattctagactaactgctccagcatctactaaagcgtgtacaataagtctcacgatgtccattaaataagtgcactgcgcggtatagacaataaagtccacaggcagatgttcgtgcggccactaatgcctacaagattgctctgacgagtcctttcatcatgttaggttactaacatgagcagcatctctggcgatacatactgattgtgtagggaggcttcgatcgacacgatctctcaccgttacgtgaacatgacgattagcgtgagaaatgtgcgactcattggagcgaaagtctatctgaattattatcagagaaatgacaatgcgaacatgaaactgagccgaatgatagcataacgtgctattaaaatccgggctaaaggtgtgaatgaaatgaaacgctcaccatctgcacgcgccgcaccttgacagattatgttttcaagtcgngcgaatgagcatg

SEQ ID NO: 5698 - DNA, 138 bp, Bacillus thuringiensis
acattgcctaatagatttttttaaccacatcatgtcgaccctgatgatcgggataaaagttactaagcgtttctgaaacgatatgcgtatgattcgcttgctaaaggtgaagaacattgtcacgctattacattactc

SEQ ID NO: 5699 - DNA, 161 bp, Bacillus thuringiensis
agacttgatagtaggcaggcaccttatacctcggtggaagcatctgttggttctttgtgaaacaacagacatgcctacataaggagcgttcccatcacagttcatggtacgcggtaagcgagacatgcgtacttattatgctaagtgaattggacgtgcac

SEQ ID NO: 5700 - DNA, 139 bp, Bacillus thuringiensis
tcgcaagcgaaaatacgccattcgcaggtgggcctactgatcaacccaactgcatgggcgagcacaagcaagaacacgcgagctatatgcctgcgcgaggccacaatgctcaaacaggacagagggctggcaggaatat

SEQ ID NO: 5701 - DNA, 199 bp, Bacillus thuringiensis
  unsure (1)...(199): unsure at all n locations
aagcccgggcaaccaaccctgggggggcaatagaacgaaagcgcccagccgaaacaccaacagcaaaggggaccacancagaccgcggacgcaaccagacgcgcacnggcggacacacgcgacacacgacccaggcanccagcaaaaaaagaaaacccgggcggncggccaacggaanaaaacggggcggagaaacaaa

SEQ ID NO: 5702 - DNA, 305 bp, Bacillus thuringiensis
  unsure (1)...(305): unsure at all n locations
tattgatggctatggacgggctcnctacaagggatggaaagacagcggaagggggcattgatggagatgaccgcacggggcctttaaccgaggaaaggccccatctcgcgcatatgctcatcacgaaccaacaccctgcgccaagggacttagcaaggatccgaacttcaactataacaacgacagatttagagcgtcttgcacatcatgctgcttatatcgcgaaggctacaattcgccttggggaaaaagacacggctgacaagccgcacacactggatgaaaagcctgcggtgcctaatgag

SEQ ID NO: 5703 - DNA, 338 bp, Bacillus thuringiensis
acgggccaaacgctcggtgggatccaaacagccaggacaaacgggcgcaaatgatggaagaaaaccgcgctcaggctcctacctgggggagagacatgttcaagcaaggtttcactactgactatacacatgattacagcgatagctactattaccagttgtggcgaatatgagctaactcggcgtaataaataagctatctctcttaagccagtgatagcaccagatggcgttttgaacagcaagagccgaactagcttagctgattcaggcgacagtaatctatggtcacaggtccattcaaatagcaatgcaagcagcatggatatcacgcaaat

SEQ ID NO: 5704 - DNA, 159 bp, Bacillus thuringiensis
  unsure (1)...(159): unsure at all n locations
ggattagagagcaaaggcatattgtagcttgactgcgagaccnnctgncgagcagggacgaaagacgggcttanggancctgtggtggcgcatggaggggccataactcaccggagaaaagctaccacggggataacaggcgtatcacccccaagagtc

SEQ ID NO: 5705 - DNA, 369 bp, Bacillus thuringiensis
aacatatgcaggtgggatgaatctctgtcggatatatgccgcacatgcataccccatggattatgagcgatagtgtaagatgaccgtatacatatcactaaccgcatagatagcttcagcaataccatgcgctggtacacccacgccgagaatgcataaagtaatcgcgttatgacgagctaaatattatggcgctactccagataaggcgcctgtgcgaagcactcgtaagcacgagacctgatagaccagcgagcggatctaccgtttgaaagtctgatagcatccaatcccgatgatcgtatactctacgatctgaatataatgcgggactaccgttactaccatcgagccaagtgcctcaagccc

SEQ ID NO: 5706 - DNA, 118 bp, Bacillus thuringiensis
  unsure (1)...(118): unsure at all n locations
tattagaatcaaaactaacattctgtccagaggagggcgggaaaccgaaagaagggagtacgcgagaacaaccagctcaacttactgcgcanacagatagatctagcatgaatagtga

SEQ ID NO: 5707 - DNA, 147 bp, Bacillus thuringiensis
aacaacaccttcaaattcgtccaacacatcaacacaaaccaaacgcagtcgtcatctcttaagacaaacaaatgggcatgaccatcaaaaaaatgaatacctaataccaacgaaatctacaaattgttacattaaaaagcgggaaac

SEQ ID NO: 5708 - DNA, 103 bp, Bacillus thuringiensis
  unsure (1)...(103): unsure at all n locations
ccgcaacgaagcagacgactttctctaggcagacacaacgaaaggcacaacngaggcactcagaacgaaaaagacgccccggaaaaagcacaggggggggcaa

SEQ ID NO: 5709 - DNA, 206 bp, Bacillus thuringiensis
  unsure (1)...(206): unsure at all n locations
cgcgagaagcaagacgacgaaggcagaaggaagaagaacacacgggnttttttacagcgacgagagaaggaagncgccgcaggggagaagcgggaccagagagcggaacgagagaagggggaagagacacagcaagggggggaccaccggcaggacgagagggagaaaagacaaggcgaggagaggacaagcgacgaaagcagggg

SEQ ID NO: 5710 - DNA, 200 bp, Bacillus thuringiensis
  unsure (1)...(200): unsure at all n locations
acaaaaaaccgcaaaagaaataagaaaaacaaagcagagccacggacaagggggggacaaagagaggaacacgcgcggaaccacccaanaccacaagagcaacgcggcgccgcaaaaacagaaacacgccaaacaanaagaccaaaaaggacgacaacccaacccccccacccgaggaagcacaaccaacaccaacaaac

SEQ ID NO: 5711 - DNA, 106 bp, Bacillus thuringiensis
tatggatatatgccgcggctcatcatacacagccagcgaatatgggcgacagggaggggactcatataaagacgcactacccgatcaacaataaagtgcagatagc

SEQ ID NO: 5712 - DNA, 200 bp, Bacillus thuringiensis
agaaaagaagggggacgaagtttttttaacagcagaagggaaacagaaaaggggggggaaacgaaagggagaaaaaaggaggggagaaaacagaggcggcgggaagggaagcagagcaagaagaaaggaagaagggggaacgagagacaggcgaaaggggacacggaggggggggcagaggagagaaggaaagaggggag

SEQ ID NO: 5713 - DNA, 136 bp, Bacillus thuringiensis
  unsure (1)...(136): unsure at all n locations
cgagaagcaagacgacaaagacaaactcaaaggcanacagaaattactccgacaagaaaaagngagaacaaagcaaggagggcaacacacggagacacaaaccgcgcgctagcaaaaaaaaaagacaaccaggcaa

SEQ ID NO: 5714 - DNA, 150 bp, Bacillus thuringiensis
  unsure (1)...(150): unsure at all n locations
aaagaacgcgaacaagccccagaggcagcggcaaaaggacgggaagccagcagcgcaaaaccacaagcagaaggggcaaacgaaagaaaaagaagaacgcccacaaaagccaaaagacaaagaacgcgggggaanagaaaaagggaacca

SEQ ID NO: 5715 - DNA, 372 bp, Bacillus thuringiensis
  unsure (1)...(372): unsure at all n locations
acaacnacaaacccaacagcatacgagcggacggagggaggatccctgcccctaggacagaacgaacgaacaaggggggggggcagcgagcgaagacgccacggaaccgccgaccgacaacggcaacagagcgacgcacccaaacggcacgngcgccgacgcgcccaacaacaccaggaaggggacagagaacngcagcacccgaggcngnngcnganaccgaccccanaccgggacccacaagcggagaggccggaggcagaaacggaaccgccngacgnngcagggncgcncccanaagngcgcggaaagagacaacgacnncaaagaacggaaaacaagcnggcgcngccgacaccacangggggggag

SEQ ID NO: 5716 - DNA, 362 bp, Bacillus thuringiensis
tgcttgagagctgtgcgaaagactttaatatcactactctcatgctagttacaaacatgcttatatgattatcgagattaaagatttgctgatgggcccccattgatcttactaccgcgtaacggtgccgctctcctatcttcttactacttatcttacaaggcctatatatgttactaacgggcaacatcttctttggcaaggcatagacgcgcgctggagcgatttgtctgctaaatatacaaaggatggggccaactgtgactttggcatcatgggtaaaaaacataaactaacgctcttggcgggacgccaatgctaactccttatgaataatggttatattgaagagcctaatagca

SEQ ID NO: 5717 - DNA, 249 bp, Bacillus thuringiensis
ttatagggggaccgatatatgacgacactttcgctggataactcgtctaccacaagtgccatagagcataacattgtggctaccattactcaagatattgacgaacgtgtacttattgcagtgggagattgacagttcggggaacagattctttgcaaagatttatagtaagagggcattattttaaacactggccttcacgatgcatagcatgccttacagattgtgattggcttgattaaagatctc

SEQ ID NO: 5718 - DNA, 375 bp, Bacillus thuringiensis
attaatgtttttagttaagatatctcattacacactctcctgtttactgcaggggaaattcagcttcaccctgctcagtaattacaaaaacaattcctttgaaagcaagggaagaacacccgtgtcagctatttacagcatttaaaaaattctgtggttttcagaattaaggttcaaagtgaatgttattaatgttgagtaataaagtagtttttcttgcacagatatactaaatgtaaaaagaaatgtttacactggaatgattttcccagggtgggaatcggggctggggagttggaggtttgggcccaccctaggtttttcaacttgacatctttacatcttacggttccagcccaggtcctagcagatttc

SEQ ID NO: 5719 - DNA, 140 bp, Bacillus thuringiensis
gacaagtatgtgcacttaacgttgccatgacgctctcattttctttcttgcggtgatttgcctatccgcccttgctcgcccatacacgctcgtgtatgtgagatgctctgaaagaccttccgaatcacgagtgggccgca

SEQ ID NO: 5720 - DNA, 417 bp, Bacillus thuringiensis
cctgggttcaaaaggttggtccacaaattaaaagggaatggtttttgggttttttttccagggaacccgtccaaaaatttttttttaaaaacattgggggaaggccatggaacccttggccacttcccgttaaataaatcctagggcgggcccggtagaaccaaggggacgtaatcttttttaatattcaggggatttttggttacaattccccttggttaaagtggatcgggtgttttttgacggccaggtaaggtgtttccaagaatatttcgttttaaaaaataatttttttttaggaaactcttttaaaagggaaaaggggcatcctgttccaatggcctttttggaggactttcggtttattaaaccatttttttcgtgcttataaatgttttagggatgaggtttttaaaa

SEQ ID NO: 5721 - DNA, 220 bp, Bacillus thuringiensis
gattgcgcgagggtctttatttggcatagtattgccttataagttggaccacctgatgctggctgttgccgaacgagaaatgattcaccagctgacctcactttttgcttcgatgttcctgatgggcctaccgaataggattctggcgacgggcagctgtgcaaggtgcgaacagaggttgcagagcatggcccgtattatgcatcaggtggtatatgta

SEQ ID NO: 5722 - DNA, 273 bp, Bacillus thuringiensis
tgcatgaatcatgacgtaaagacttaactaacacttgtttttttttacttacagctgggcttgtatgaatatgtagattcgaacgctattataactgctcgatcggtttttctaccgtataaaattgcggcgcttacttactgttactcccgatgttatacggaccatatatgctactaatggcatacattttcaggtgtatggcatatcccctcatgtgatcaatcccccttaacgataactcaagtatggtggccactgtgccatcgggat

SEQ ID NO: 5723 - DNA, 520 bp, Bacillus thuringiensis
  unsure (1)...(520): unsure at all n locations
cgggggttataggccaaccacgcccccaaaacccgggcccccaaaccaaaaccaccggggaaaaaccccctacttttaaaaaacaaggaacccccaaatncaggggggcccaaaaaagaaaaaggggcccccaaccccgaaaaggccaaaggggggagaaacccccgaaaaaccggggaaaacccccccaaaaaaccggaaaaaccccggcaaccgggaacccccaaaaagggaagaggaaacccaaaacccccccaggagaaccccacccagggggaaaaaaccccccccccccaaagggaaaaagaaggccccgaaaaaaaacccaggggaaagggggccccggcccccccaaaatttaaggggaaggccccaaaaaaaaaccaaccggagggcaccccggggaaccataaccgggccaaaacttaaccaaatttggggaaaaccctcaaaaaaaaggggaaaaaacctccacaaaccccgacaaaaggtggggaaaaaaaaacccaattaattttcc

SEQ ID NO: 5724 - DNA, 338 bp, Bacillus thuringiensis
cgatgtgagcggtaaaccgggcaattgggaggcatgcactttttttttgggaggctattcaaaaaacagagggctattcgtctccggtctcttaagctgctctcaagcggtagagttgcacatgctgggcggcttctcatagtatctaccggacaattgaaatttccgcatagcgacaccaccagagaaaatatcggcgtggtatacgctgatgataattgtgatacatctgtgccttcgcggatcggatgaatattgggttcaatgtctaaacttcacattgcgtcatatgcaatagcaacaatctgcaaacaccggttcaaaagtttcaagcatgt

SEQ ID NO: 5725 - DNA, 208 bp, Bacillus thuringiensis
ccggcatacaaattgtcttggattttttcataaccatttgttctgattcttcgttgatttctatgcttgcaacggcaccttgtttgatttttagaggagcgcaccattcttgcggtaatgtttaacctaaagaattgccgattctactaactttacgacacgattttgctgagatcccatgctggctaagtgctggctcacattcaga

SEQ ID NO: 5726 - DNA, 129 bp, Bacillus thuringiensis
cattccttcatcaaccttaaaactgttttaagagatacttttttgaaaacaagtggcatctctttaatatagggggttctcctaatactgatgaggtgcgagtatgcgtcctccacttggtattgcaaa

SEQ ID NO: 5727 - DNA, 227 bp, Bacillus thuringiensis
tgtgtatacaaacgaaaaatgttttattttaaccgagttttttatccttatatatttagatgagtattaatctggaggttattcgacttgagaaatgtaatataaaatcgctttaatcgcgcaaaggtgcctgctgcactcacatgggatttatccgatgtggtaacgaccatgccagataccatactgtattggacctcaattggcaacatgttttacacatgact

SEQ ID NO: 5728 - DNA, 138 bp, Bacillus thuringiensis
agcttaatttactttactatttttatactggacatgaccatcttaataatatggcaactctatatgtgcggtattttctagagattcgcgaaccctatcgtacaggtgatttaaccttggtcgattcgaacgtcatga

SEQ ID NO: 5729 - DNA, 236 bp, Bacillus thuringiensis
ctgggagccgggtgcatttttgaatggtggatattcttgaccgactgcggcgtggaattcgatggacctccactattgtacgcgataaccgacgtcagcgtttgccagccaccatttttgatactgagccaacgagagctatgcatatactctgacctcttgctgatacatatccccccctgcgccatattatgccatgatgatacgacctattctaccaccctatatgtatctac

SEQ ID NO: 5730 - DNA, 202 bp, Bacillus thuringiensis
  unsure (1)...(202): unsure at all n locations
cgagaacgcatgagcnagcaacatagttcctgtcgcctgtactatctatagtgcaacagggtgacttacacatgatgtcgaaactggatctccgaaaactgatgcagaaccaggaccacataaggctgctttttagggagacaaagagttggtatttgattaatggaaaaagcatgcgcgatggacaattgaaagacgacat

SEQ ID NO: 5731 - DNA, 192 bp, Bacillus thuringiensis
agataacgttgatgcatagcgcttagccagacggaccgtttaagacattgaacatatggaaagggcaggggacatacagataagtatccagctggggcaagatgttccgccagacgaagcgactacagattccgatttgaaagtttggaaagtgaacttaactattcataatacaccgccttagatagccga

SEQ ID NO: 5732 - DNA, 213 bp, Bacillus thuringiensis
ccgaattcatgaattgatttgcgaattgcgcacatagtggtatgatggaaaatgaatcgcctatgtccaagcgtgctcaaatactcacgcaccagtgcgtagtgttaaaacgacgagattcgacaccgcttctagcaaaataggatgtatgtcggtacttctactgatacatagtccagattggttaccatacgtattcccacgcacgtccag

SEQ ID NO: 5733 - DNA, 191 bp, Bacillus thuringiensis
acatatatacgatgtcccttcgcaagaatccctgatacaacttgtccgaatcacggcatggcaactcctggtgtcgccatcgtgatgaagaaaacgattgtgcttatgctagctataggctgaggtggtgctgctacttatcctttcggctgactagctacccacattattactcggctatcaatattaag

SEQ ID NO: 5734 - DNA, 207 bp, Bacillus thuringiensis
gggacggttcttccatatctatagctatcgtaggaaaaatgcttttacgactcacgagatgatggggaaacccagggcaggatatcatggtggacatcggcaataatcgaaaaagacaactatatagttggctctgactgttattaatcaggagcagatatataataggtggaaaactcttacaaaaacggttactttggcatatac

SEQ ID NO: 5735 - DNA, 328 bp, Bacillus thuringiensis
gttatattcgctggctatattgttaccgactactgaaacagttggatgtgcaacacgtgcttcacctatatacggtgaatcatgtttcccgatgtctgtaagtagggcaaatgatatagtctgtgctattataccctcaaagattgatgctcgcagtgctccatgtgtcatcatagcaagttgaaaataagcgatgtaaatgtactgtgctccttgtcgtatcgagccgataggagcagtgtgcgattcatccatatcttgcggatcacaccgtaggggtggtaggactagggccatattcttaactattaatagagcctttgtctaa

SEQ ID NO: 5736 - DNA, 123 bp, Bacillus thuringiensis
cccttcccaacagttgcttgtcttgaaacgaataaaatatctgcaactcggggcccttttattacaactatcccgaacataacagccaatatacatgttcctgcgccattcgctccacttact

SEQ ID NO: 5737 - DNA, 181 bp, Bacillus thuringiensis
gttgtcttcgacctctttatcctacagtaccgctgactcttttttgttattgaagactgacggccgtacctccgttacgtgccgtctccgcatctaccttactagatccactgtaatgatctgttggaactggacatcaatatgtgcaccataagccaccctttcattcttcttcttgctt

SEQ ID NO: 5738 - DNA, 130 bp, Bacillus thuringiensis
gggagcagcgacctgaatgtcacacgccctagacatcccctgtcgtagagaagcatgcagcttcgcgtagaaagacaaaaatacataagctagttgcgaaccacctactgttgtgacaacttcttttttt

SEQ ID NO: 5739 - DNA, 217 bp, Bacillus thuringiensis
ttaacagattctgaatcttctaatgaaacaatcaagaattttaccgagggcgattcttagggaaaagtaactggttcgcctcttatcggcgaggctgtccaaagaccttctcttcatcgatgaattgcatctcagtgatctataattcagcatcttgcataggaaatatttctctaactaataacggttcttacggtcgtttctctagaccccttta

SEQ ID NO: 5740 - DNA, 127 bp, Bacillus thuringiensis
ttcattgattaaatatgccttagacggattgaccaactttttctcggcctacgcaattacagatgcgatggagcctactatcccatcaatgtgtaccgtctaatgccactcatgacggttaattata

SEQ ID NO: 5741 - DNA, 243 bp, Bacillus thuringiensis
ataccaggggtgctgttttctaagacggaatctgtcagggtgtaactcgggaccgacgttcactgattctttatttcactctgataaaccaaccagagttaccgagagtgaacccgatgagcgtgctgccagttgttcctttaattatgggctgacatccggaattattcttgcatggcactgtgccggctatatcacctcctattgtgctatgctatggccccgttacatgtcttcaatatc

SEQ ID NO: 5742 - DNA, 192 bp, Bacillus thuringiensis
aaatcacaaatgcagtatgcgtagacgctattgtaaaactcgctactccagcccctgacaaggaagctatccctacgacacgcccagagcgagagacagcacacggttagctgctgcaaaaccgaaagcacgcctgctacgactgaagcaacttcaaatctacaggaaattaatggtaacctcaataaaaag

SEQ ID NO: 5743 - DNA, 339 bp, Bacillus thuringiensis
gctgcgattgcaggggagttacactgatattcctataatgatttttttcgagttatcttcgatactaccatttggggctacttataatcactgttaggagacaccccatcatgacacgtacgcttgcttgttggtatatatgtagttttattccgaatgtatattgactggatcacgctaagtatatatcatatgtcaaaatcatattatatcgtagtattccctggttaattatacttctcaattaatctgcaatatttttttcctttggatggtaaaatatacatcatcagtaaaccaattacttaatggatggccttgctatttcattttgataat

SEQ ID NO: 5744 - DNA, 133 bp, Bacillus thuringiensis
tctcttattattaagcttgcgtatgttctttatggacacatttttaatgagatccacatctcccgtatcgcactgttgatttttaaattacagagggtgcaaaagtatatttaaagacttggtatttcaattg

SEQ ID NO: 5745 - DNA, 367 bp, Bacillus thuringiensis
atcggtttccgttaatttcaaacgagctgctaaaataggctattgtgttgggataggttccgctctttatgcatcgtcgataccatgagtattacttgatgcgatataccacgtgttatacgtatgaccatcaagtaatatatcgtgcatgcgtaacgttacactcagtccacatagagatggaattgacgtgccacctgttcctaaaaaacccttgacctttaatggcgcgtaatgtccttcattcaaaccgaatgttaccgtggggtcattaatggactgcagcgctccaatcatatatcactctgaaacgagaatggaagagatactaataatacggtccgactaaattcgaaatttccttagc

SEQ ID NO: 5746 - DNA, 260 bp, Bacillus thuringiensis
tatttctcagcacggattgaattctgtgactcacctacatgttgctggaacgcagtaattcacggagtcactgtgccgcggtgaatacgttcgcaggccttgttcacagccgaccgcaacacctctagagttggtaacaccttatgaaagacgggtaaccttacatgatccaaacacctcaggttgtacacaggcttggtgtgatgtcgttgcaagtgggacgaataaaagggtgcggatggatcatctccttgatatgg

SEQ ID NO: 5747 - DNA, 108 bp, Bacillus thuringiensis
aataggtatgacattgggttccggtgtggcggttaaagaagaagctgttaaacggggcgtaatccatgtcatagatgaatccttgccgacagacgattacgatttcat

SEQ ID NO: 5748 - DNA, 115 bp, Bacillus thuringiensis
cgttggcaggtgctgtaacaatagacgtgggcaaatggatcttaccaacaccactagggtctggacatactatgtcgtcgtgtggctccaagacacgatgcgacagaaaatttta

SEQ ID NO: 5749 - DNA, 383 bp, Bacillus thuringiensis
gggaaagttcgaccatataaagagctatctccgcctaaatggtttatgaatacagagacgatggtgaaaccgcaggcgtgagataagggagggcatcgttactaatcgacaaagacatctgtttacccgcctattaataggactaaacaggtgcaaatagcgaaaaggtgtaactatatcaacatgaacggctcccttgcactatagttacctaacgcaaggatgtatcctgcagacacgggcaataagagacctaccttcaccatcagtgaaagcaaagaagttttagtggggccagattgaccgccaaagccccataggagtgggcgaaaatttagagaaggaagaactctacccccgataagcaatgcaccaactatggt

SEQ ID NO: 5750 - DNA, 193 bp, Bacillus thuringiensis
gaagagcgtggaccaaaattcaaagtggcctttccttgggaggatatttaagggagagcttagaacccttgcattgggaaaaagaaactgttggtttattcaataccaaaggcctttttgggccttgaatggccccaaaaaaaggctttaaaaaaattaaacgggttttaaaaccggggggggcctaaggttt

SEQ ID NO: 5751 - DNA, 283 bp, Bacillus thuringiensis
gtctgcttgccatgcacttattcgtccgctagggaaagaaacgagatcaacgacaccttgaagaataccatagattgagaaaagcacgggaaaacctgcgcgctttaactattgagcatgctctcatggggctggacgaaatgggatttaatcctgtaatcattgcactgtgatacagactataatgtgaggctgtctgcttatctaacgtgtaggcccactacggtcagtcgatctgctacctcgctatcgggttttcgttggattttgaggtccggcccta

SEQ ID NO: 5752 - DNA, 474 bp, Bacillus thuringiensis
cgggtcgatctagctcttcttcatttccacgaggcctatgagttccttaatacacatgtttattatttattaaacggatcgaagttaccctaccgattcgcgctttaaccggttgtggatagcatacctgccaagttcgtccttcatgactagtgtggctcgccctatatagaccgctctctattgttagatatgccatataatcgttgatatcatggttggtgtcgattggcaccaattgcatttaaacataaattaagctttgtctgcactgccgtagcggcctataatatggctacctgcgatatgagctgctgctgtttgatgaccttatgaatgagtagaggacacggtcgcgatatttgctgtttccttctgacagagctggattcactatagccattgatagtgtaccctgctcatgatacacatctgccgattgctgtcctaagacttacttatctatgccatctg

SEQ ID NO: 5753 - DNA, 353 bp, Bacillus thuringiensis
acatatgcgctagctgatcgctggttttcgaaaagaacaatggtcgctggatatcgctcaagtgtgctgtctctaatgggagtagattagtagtgaagactggatcattggcactgcttttcagttgcaacagtcattggcctaattgtgggtcagtcgtatcagccctactctctgtgtcttactaagcagctgtgacagtgaacgagaggaccaaatgcgattgcattgacccaaacattaccacctttcttggtgattttcggaccagtgcgaggtcacgatttctctggccaatactgcacgcgcatgccgcttgctgtgcaccgcactttaactgaagagcggcattt

SEQ ID NO: 5754 - DNA, 198 bp, Bacillus thuringiensis
gctaccacgtgcttcatgatcactacctagatgactgtagcggagtttaaatgcaccctgaatagttacctgtaaatgtcacacatagcgctcatgtatacctaaacaaaacggctgcatgctgcgacttcttattaaataatcgactggtattgtaacaatagccctgcatgaccgccattttatcaactagacatt

SEQ ID NO: 5755 - DNA, 341 bp, Bacillus thuringiensis
gctctgcgctagaggcgcgtggacacaaatacatagtctgcttacaacgggattatattacacaaagcggaaggcgcgggcacagcgctagcttaaagcggactttatatataaaaaaatacggcagattctgcccgatttacctcagaaggaagctacctatgtactaaacgaactggtatctcaggcggggatcattgtccagtgagacggcctaataatccaggctcactgcctatcgaaagggtaagcacactatcatcgggcgatatgataatttcgtgaaccggtctttatgggaatcccatctgcagccctaggggtagcagccaacttcttaa

SEQ ID NO: 5756 - DNA, 232 bp, Bacillus thuringiensis
gaagggtctgggagagagtatggtggggggggcctacaagcccagcgtgggcccaatggatgacgccatgaccaccccctgcaccacacaacaaatgatgatcatgattttcttctgcaccataaagaggagtgagacaggcagacagtgagagagatctacactcggtcagatgctgggacagacttggcacagggcggcagggagaagaggggagagataacagtatact

SEQ ID NO: 5757 - DNA, 365 bp, Bacillus thuringiensis
atatcataggttatttaaattatataaagaatttgtatttgaaaaacatttaacgtaattgaatagattgtttatttttctctagtaaaccaaacaaaaatacagattgtgaacaagatgaatgttatgaaggaaataactttgattacgtgctgaaaacgggaattatacaggcatggtaattctccgtttttatagacttctattgtgcgaatgtatgttcacattctatgtttgcggtatttgcgactggacttagcattactggaactgtgaacttattcgctgaggtcgatgcctaatgaagtgcattatatgacttagctaacagagctcacttcctataatttgaactgatgaatatg

SEQ ID NO: 5758 - DNA, 165 bp, Bacillus thuringiensis
cccacacgtgtggcaagctgcctaggctcggagctgcacgaattcagatgatgtgtgcgggcatgttgtgaaccacatgttgacccctgctatgacactgtgactaataaaatggccgccttaccatagatgaacggtaatgaccatactgcttctccggccagg

SEQ ID NO: 5759 - DNA, 173 bp, Bacillus thuringiensis
acactattgaaacgctgggctttaactctgacagctataaaacgattgcattgctagttgccagcgctcctacgcgaggtgcaaatgctcaacgatatcgatagatcaacggctctataatccatacttcatcatcctggtgcgacgggcgctctacatgctgtcatacatga

SEQ ID NO: 5760 - DNA, 228 bp, Bacillus thuringiensis
taaccatccagaattccatgaatgttcccccttactaactttcatttgttttatttcactaacttatcagctttagttattgaaatcattcattccttacaaggaaagggcaaactaaaactttctcaaaaatttgtactagacatgatttctcctcaaggttgctcaaaatggactggattaggtgtttttctagatgattctaatgaagaattacagatttattca

SEQ ID NO: 5761 - DNA, 148 bp, Bacillus thuringiensis
cacaattcaataccgagtggcaattttgagactcttcttgaaaatttcacgactactgatgaataagctcgaaaccgacagctgtcaggaggacccatacttatgccataggacatactatgctgagaacctagcttataacaggcaa

SEQ ID NO: 5762 - DNA, 185 bp, Bacillus thuringiensis
taggtacaggaccatattatgaaggaaccgggactacagctttattaggcgctagaccgtgtatcacgtagacggcccactccttaagccgttacccttattagggtgtttgtggtaatggcgcataaacaatctaattcagttcctctaacggagccccttgtataaagctcgtcggatatagc

SEQ ID NO: 5763 - DNA, 190 bp, Bacillus thuringiensis
gatattcgggtcctccgggttgtacagggtgtataacatttggtagagacaaagcgttcaccaagccctgattaaaatccccaccctttcaaaaattgacttggcctttatggctttatcgccataacagccataatttcggactctgattgcgttcccctaaaaacttttatgtaatttttcaaggact

SEQ ID NO: 5764 - DNA, 247 bp, Bacillus thuringiensis
gagaatataccttttgacgcacataggggaagactgctggattcacttttaactagtgtcgaacgtgcctgttatgtgagcccagtcttgtcaacatgccaagtaatcctaccgcgaagctagcatgactaaatatcacttcgttctcgagagttgtcgctacatggataaaaaatagctgggtgggacgcgtgccttgtagaaccagtttctcacgctggtggtgcaccactcgccttacaaattg

SEQ ID NO: 5765 - DNA, 191 bp, Bacillus thuringiensis
gaggctaccactgcttctccctctctaaagcttaacctttgcttgtttcgttactctaacaatcctaataccaaaggggggcttttacccttcaaccggctaagaccatctgtaagcacacggtttcacgatctctttcactgcccttccggagtgctcctcaccttcccctcacggcactggttcactat

SEQ ID NO: 5766 - DNA, 191 bp, Bacillus thuringiensis
tccatagtgtattccacactaagcaggggaatgaatctcttgcgacaactcctgatagatactgacagactaattctagtactgtccgtgcaagctgacgcgaggattatagtacttaaccgttaccggtatctataccgacgtgaggactcaaccagctgcttaaagcaacactgggaaaactaaaagtt

SEQ ID NO: 5767 - DNA, 195 bp, Bacillus thuringiensis
tagatactggatgttagtcaaagaaccacatgaagcatgcccttattcatatactagtatcgcttaaacagatgcttgaaataaccataagctctcataatgcatatgactattgcatatcttgtgcagcgtgatatcacatgtgcgcaggtcttgaagggaagcgtaagctggccgtaaatcacgcattgctgg

SEQ ID NO: 5768 - DNA, 189 bp, Bacillus thuringiensis
gcttacggggatgattgattatttgctgactatggataacagacgcactggactaacggatttacaaacgaaaatggaccggacgctctataccggactgcgtgacgaatactttgtaaaaaaacttgatggcagtattgcattaccgattcttaatggtggatttacactgtgaaagaaaattaatcg

SEQ ID NO: 5769 - DNA, 124 bp, Bacillus thuringiensis
gatgcacctgatagccggttgaggatttttgacaccctcaattgcaggatctaccgcatacagctagcgtatcatcacatctgtatgtgcatctgtgagtattccttcatgcatctgatagatt

SEQ ID NO: 5770 - DNA, 164 bp, Bacillus thuringiensis
atcgaagctatggctacgggcacaccaattgctgcaatagcatgtatggtaggcaacactattgaatgcacggcgatagtactggagaagtctgtgtgccccagatctcatgagtattgcgaatcacaattcaacattgctcttatgcgaactatctagtgaat

SEQ ID NO: 5771 - DNA, 157 bp, Bacillus thuringiensis
tataggaaggacctcgctctggaactaaaagatcacctcttgtgaggcaggaaataaaaagataaatgaggggcatccagtagcagcaaaaaggggtatacataatgcatcaaggacggaagattactagaagaggaatgcaaaagtggagggaacc

SEQ ID NO: 5772 - DNA, 252 bp, Bacillus thuringiensis
ttgcaaagactcggtaatttccgcatgtacaaacgcctaacatttcttgtattaacctgggaggttgccctcagctagtacccataatagcacttgcgtatcctgttcactactacaaaccacttctcattgcacatctttttcatacggttcacctacaggatgtgaaccgtcctgaccacccggtactagctaaaccacatactcattcacatgcatgcttattactaccgccgtctccaagaacatatt

SEQ ID NO: 5773 - DNA, 294 bp, Bacillus thuringiensis
acccgtaccggtcggatcccaattcgtgagatgtaattaggcgtgattgcagaactaagtggtcgtatcgtctttaaatcctaaggcggaaggatttggcggggcacataccgacttgcaatggggaccttaccaccatgagttgcttgaactctaactgctgtactatactgtataatcggaattggaatcgatcctcgtatacgtgttttctgaaaaggatttttcaaacaaacccttagcttcattcgtgctgcatggccaatcgcttttgctatggataaatggaggagc

SEQ ID NO: 5774 - DNA, 245 bp, Bacillus thuringiensis
acgttacggcaccattacgtgattaattgaaatgaattgtattcaattcataatgtagggaggtatcgggcgtgaactctcgatcctgatatagggacgtgtgttaattatatacaatgatgtatatacaatgaatcaactaatagagcgcacgaaattcaacagatggtgatagactcttatcaagatgaatgtcatgctatagaacctgctgcataattagttttttataaatatgcatcttt

SEQ ID NO: 5775 - DNA, 320 bp, Bacillus thuringiensis
ggccccccccgggggttttaagccctccccaggcctggaaaggctggcccccaattcaaattgttctttgggaacccttttaaaaccttggaaaaaaaaaccctctttttggggagggaaaattaaacgccccctaaggccccttgggaaaccctgaaccggggaaatttggttttccaaaagggtgtggaggaaacccggttgggtgtccctgcccccctaaaaatttttgttgcccaattttttaaaccgaaattccttggaaggccggctccctaaacccttttaaaaaaaacctccccttttggaaaataggggga

SEQ ID NO: 5776 - DNA, 232 bp, Bacillus thuringiensis
gtgacactgcaagcatttttcctggagctaactgtatacgactctatatcggcttccgtggacatgggctcacaactatctagccaattgcattaaatgaactgacgatggacccttccttgtgtgtttactaacattcacctaatagaactgccctgaacaatatgcaatgatccaacctacatcgcctgcgcaacgctggcttctttcatacctcggtgtaagtcaagac

SEQ ID NO: 5777 - DNA, 188 bp, Bacillus thuringiensis
cgaatatagaccgggcgatgtaattttgcccgatacgggcgagcagctatacttgggtgcctaagctccaaccccagaggcggaggaaaagtgccgaatttgcgctatctttaaaagcgaagtggcacgtagacggcgcctggctacggtatttgctgtggatggagggcttgggaggattgaatggg

SEQ ID NO: 5778 - DNA, 430 bp, Bacillus thuringiensis
accaacctgatgctccaatttgaacacagtggtacacacaggcatacctgcctgcccaagcgacacgtttagatggtcagtaccagcggacacacttccgacaaatactcaaaataagggctgcaaaaaagggcccgacaccaggtatagatctgatgggaggatctggacataataaatgcctggacatttcaacgtcacattctacgaatagaccttcgatgacactagcaaggcccatcaacaatcaaagtcgcaaggaaaaagccactatacagacggctacacccttccaataaaatgctaaggcccttaactggaaggctgataccgttcacaggctattgcgactggtccgctcaataatgtgtgacctatcacagatggccctatgtccatagaccctaggataggccctaacgcgtaagat

SEQ ID NO: 5779 - DNA, 323 bp, Bacillus thuringiensis
ctactgtgacttcatcattgagagcatggaatgctcactgagtcattgaatcactcattcattcaggtgatggagcttatggtaagcctgctaaagagtttgtggatactactataccatgcacacacataccagccgtagttacttgatcaataggtgcattgaatgaatatatataaacactcaggtcggaatttgctttaagaatataaccctcgggattcaatccgaatgccactgttgaacctttagcagccgatgcggaactatcaacataagttcatagagcagggggtcaacctattgaagtgccgtctggttaa

SEQ ID NO: 5780 - DNA, 232 bp, Bacillus thuringiensis
acgtggggtttgaagctggcctgggttcggaaggctggtcgccaaattcaaatagcacgcctggcgtgcagatttttgaaacacttgatgatatgccccccgagcatgtagcgcgcggacgaaagagggtattcatgcatggtgctgacgctgataaacactcgaacatagacgatccaagctttgcgtacggccagagtgactaagaacacccagatgcagaatactctcc

SEQ ID NO: 5781 - DNA, 100 bp, Bacillus thuringiensis
tggccggaatgggcttaattttcaactcgctgactggcgtaagcagaaacgcgctcggcagcgacaaatttgaaaggtggggcggatctaaaaaaactct

SEQ ID NO: 5782 - DNA, 441 bp, Bacillus thuringiensis
ttgggagatccgcgtggagtttaaggtaagacactatcgaaagactgcctagtgccacttggtggaccgtctgttgagggtgcgaatgtcgatgtacgcgatatactgcaatacgtgttgacccacggtcaagatgatcttcaccattgggtgattttcataccggggcttagccctcagcgaggagtcccctcgacttatgaagcgactccaagggcccatgaacgtacgtagaactataactatgactccagtgcagtgcctgtcccgaatgcacgatcagctctgcactagccatgtgtaaaaatgctttcaggagtagtgccggtactgataataatgtcaaaacccttataacgactgccttacccaagtttgtcacccttctaaagtgaactaatccgagtagatgtcgcagtgtctaaaacatgcacgatcgac

SEQ ID NO: 5783 - DNA, 172 bp, Bacillus thuringiensis
ttgaaagtttttgtctcctttgtttctacagttgctttttcggggttattcttaacattagtagcgtcaaaaattgttccaggcatgatgaacatagaactaacaactgcccatctagtagaaagtactccctgcgatatgtaacgcctacatgatataatacctaataatt

SEQ ID NO: 5784 - DNA, 237 bp, Bacillus thuringiensis
  unsure (1)...(237): unsure at all n locations
accaagcaagaccgaacccgcaagagaaaagaaccagnccgcnnccaacccccanacaggaacgaaacaacaaaagacgcncccaaaaacccaaaaacaccaaaaaagcccacaccacacaaccaggaaaaccccaccaaaaccacacgaaaaaaacaacccacaaagaacccaaacgcacaacncacngnggccgcaaacaaaaaaacaacaanaggagccaacaacaagcacacc

SEQ ID NO: 5785 - DNA, 458 bp, Bacillus thuringiensis
  unsure (1)...(458): unsure at all n locations
gagaagcaagacgacgagacngatatcaactggaaaaacaggaaaactcnnacaggcccaacaagaccacngnaggggagggttccggaaggaccgaccgggggacaacgaccgacgggggagaggggcccgacaggaccccaaggcgngcaagggacacaaggaccagccgggacaagaggggcaaccggaccagaaggacagcacggaaccacaaggggaaaagggggccacaaggagcaacaagagcgaccaggcaacaaggggagcaaggaaaccaaggccccaanggaacgacaggagcaaccggagcgcaggggacacaggaacgaccagggagcacaaggcccgaaaggagccaccggaccagagggaccccgaggaacccaaggcgggcaaggagggccagggggaacagggccccaaggaacacaaagagcacaaggaaagcaaggggc

SEQ ID NO: 5786 - DNA, 321 bp, Bacillus thuringiensis
ggggaggacgaatgcaggatacgggacgattcccaactgctgcgcgcacggcaacgcaccttgcaactaaagagagaaatgctagctaggcaaagccatgggcataactgcgctctataaataaggcaacgcgcacgacactatctgagaacttacaagcacagaaggcaaatcagcaaagcctgcagagcacaaagcaagagcgtactgccattcaacgaacaagcgatcactgcccagtccgcagcacaggaaacctggaaagccaacaccagacatgaatcgaccaacgcgcggtgagacaacctacgcataggggaa

SEQ ID NO: 5787 - DNA, 546 bp, Bacillus thuringiensis
  unsure (1)...(546): unsure at all n locations
agaaacttatattaagtttccgtcantcctaagttcgctcccgcaaagtttgtagacaaactcgttggaagtatagagaaagagagaatagaaatgaaaaaagtattcaagttactggaatatccgttggtgttttcgcttatcattacaatcgtatctggaattttgattatgtatagtgctagcttcaattgttgcagtcgaaaaatatggctatagtagtcttctgatgctaataagagggaacttataaataaaaattactatttatggtgagaataatactatttaagtgctattgaacttctgaatttaattgaaaattcacagtaattataaaaatgtagttttataattatttttttaaaacaggggaattctatttatttggataggaggtaaatttgttgagatctaataaaaaatatttttataaacaggaagtattaagcaaaaattataatatgctaattgaaattgcagaaagtgatgttaaatcaacgttagattttgttaaaacaacgtctcaagggctgtctcacgagg

SEQ ID NO: 5788 - DNA, 156 bp, Bacillus thuringiensis
  unsure (1)...(156): unsure at all n locations
acattatttcctanacngnacaacaagagnagccggagggaggccagcagaggaagaacgccggagcaccgccnacagacaggggaangcggcgacaagccccacgagccgaggccagcgccagaccacacgngcgggggcccgagcacgcggccg

SEQ ID NO: 5789 - DNA, 154 bp, Bacillus thuringiensis
acattactaacaaactgcatatttacaaccctcttcgcgaatgaccctgaatcggttggctctttaacttttacaacaaatacaaatccaagtgggatatctagtacaaattaacccaaacattttttcactatcacctaagcctttaaactaa

SEQ ID NO: 5790 - DNA, 508 bp, Bacillus thuringiensis
  unsure (1)...(508): unsure at all n locations
agagaagctgttgaaataacatttccatcgaaagggccttggaaagtactagtagacggcaagcaggcgggaagtaaaccactttatgttgtccatgacaataaaattaaagttcctgcattaagttcatttgtcttaaaaacagagaaaccgattaaataaaaacgaagaatgtggaaataaatactgcattgagcanatttaataaggattgcaaatgaaaaaagcgaagtgaagattattctcacttcgcttttaaagttaatgtaatataatttcatatactgtaattatattacaatttaataaaagaaataagcaatagattatttcttttgtgacagtaggaggagaagatatctttgagtttatttataaaattacctgaaatacattcgtaatttatataatgcttattatatattcgaacatataacgaactagatgttagagttgtattaattcctacaaatcgtttaaaaataacataggcgtgaaaagtatatgg

SEQ ID NO: 5791 - DNA, 168 bp, Bacillus thuringiensis
  unsure (1)...(168): unsure at all n locations
cacagcggacagcgncaacaaaccccnccagccgaagctagcnctagaccacaccngggggggcccgagcccgcggacacagaacgccaaaanggcacccaaaaggccgaacaagccacngagccgcgcccgacaacgnaaacacagggaaaacacccgccaaaccca

SEQ ID NO: 5792 - DNA, 273 bp, Bacillus thuringiensis
  unsure (1)...(273): unsure at all n locations
aagcgaaaaacaaacaccaggggggccacaaggagggccnaagcggcgcgacaacaccaaagaggggaaaccccacgaggggacgaaaaacggagcgagcaaaaacaaaggagccgcgagcacaaaaagcacggaagcaaaacgagagaagaaaaacccaaaagcccccgggggaggaacacaacgaaacacaaggcgccaagaaagaacaggcggaggcaaaaggaaaaccacccccccaaagcaaaccagaaaaggcccgaacgcaaggca

SEQ ID NO: 5793 - DNA, 188 bp, Bacillus thuringiensis
  unsure (1)...(188): unsure at all n locations
aaacccacaaacncctagcccaagagaagccaaaaaaaaaaaaaaggggggaccccaaaacagaagnaaccccccggccacacaccaaaccccaaaaaacaggaaaggcccacaaggaagggcccaagnacaaaaaacacccccaaaccggacaaagacacacacacccccaaacacaggaaaaacca

SEQ ID NO: 5794 - DNA, 450 bp, Bacillus thuringiensis
  unsure (1)...(450): unsure at all n locations
aaaaaaaaaaaanaaggggaggagccgagcggagagacaccgacgggcacccccaancagagaggcagnaagnagaaccngaaaagaaacaagcgacagaaacgaacaaaaacgaaaacgcagccacagcgacagagcacaaagaacaacaaacaaacccaaaaaacacggaacaaaaaaaaacacaacgacccacaaggaagcgcaaagagacaaacagaaaacacgcgcacgaagaaaaaacaaacagccaagcaacacagaaaagaacgcagagaaaaacaaaaaaaaccaaanaacgaaagacacaagcggcaaaaaacaaccgcaaacccacgagaacacaccaaaaacggggccgaaacgaacacaaacgaaacaccacacnacaagaagcgaggaaccacagagcaaggcaacacaacagaagccgaaacccaaaacaagccg

SEQ ID NO: 5795 - DNA, 189 bp, Bacillus thuringiensis
  unsure (1)...(189): unsure at all n locations
aagcaagccgaccaacggagacaaagaaacaaacaacaaaattacaccgcaagcnaagacacaagnagnaaggggagggcccaaaggaggngaaacgacgggacaaaaaccaccagaggacaaacgaaaggacccaggagcgcacaaacgcaggccgaaacaagaaaccaaaaaaagaaggcacaccca

SEQ ID NO: 5796 - DNA, 361 bp, Bacillus thuringiensis
tcgtgtccactcttactatacctttagcaacaaagtataaacgatcctatgacgacgtctatactgcaaagagagctcgcctttttcaaagagatcaaattgaaaatacgctgtatctatttctgaaaaaatctcgagcgttatattggatatcaaatcatgcgtaattaaacctgatctatcctccatattcatttctcctttcatctacatatcaaagacgacaatacctagcatcatcattattggtcccaccataggacatctctccatctgtatcttacttatatgaaatcgtcctttcattacaaaaactggggccgttgacagttgagcaaccataagtgtgccagctgacaat

SEQ ID NO: 5797 - DNA, 222 bp, Bacillus thuringiensis
acatgcctggtaccgaacttccgctatctggagtcaaatgagagcctggcacaatcacagacatcacacgatcctgtgtcaaaaagtgatccgcccacaattcctcacaacataccatcctgacacataaagcgttaagcccactgcgccttatgaatgagcgaaaccacattaaccgcctggagctcactatccgctatccagccgggaaacccgtcgtgc

SEQ ID NO: 5798 - DNA, 317 bp, Bacillus thuringiensis
  unsure (1)...(317): unsure at all n locations
agcctcgctcagaagctcgcgacaattcagatccccattcgcaagccggaactgccaggacgttcgaaacgacaaccgagggggccagatcggggggcaaaaggcgagcgcacacccacgaaaacacaaccgagcccagaagaaggaacagnaccaaccggaacacgacacggaggccaaaccgaaaacacaggggaggacgcccggacagcacgaaggacgggccaccaagaaacaanagcggagccacccacaggcggccaaacacgaacaagcacggacccaccaaccggaaactacagcagncaccgcgacga

SEQ ID NO: 5799 - DNA, 350 bp, Bacillus thuringiensis
caccagcctgtcgatcatatactcatctggggtgaaatcttgtattcattatcaaggcgggctaaacctatcgtgacgcatagttcacactcaactaaagactcacctggatttgcattgaatatggccaggggaaccagacttccgctatgagaatacactgccccgtatatacacagtacatcctgcgctaaataatgcttctccggatatcggccgatctatctccgggagggagttaaacgcatacactccgtaggcacaccctcttccataggtcgtgcaaggagcatcagactcataatttcctgctaaagggccaacactggctgctagcgtgccccatgctg

SEQ ID NO: 5800 - DNA, 210 bp, Bacillus thuringiensis
cggaacgacacctacagtggaaaatacagaagagatgagaggcttaatactatcaacccacggaccatctgccaactgaggtgggtcaatatatcgctataggaatagtatgcaagattaattgctataacagctgccaccgtatacgcaactaaaatacataccacaacgaaacatgatacagccatacgctgtattgcatatttggaa

SEQ ID NO: 5801 - DNA, 368 bp, Bacillus thuringiensis
caaggcccgatgtagcatgggtgcatgaacagatatcctggaggtggctcaatgtgatttttaatatcagccaaggatttattcacacccaggcttagatgcaaacgatacacgcggctcatagcatcatggtgacctaaaagctgcaggacctaatgatgttggatcaaaccatttggcctcgatttttagaataaccggaactggaaaccgaccaggaacttatgcgctaaaaagcaatgaacaacgtccaacttcatatcgcgccgaggatgaaactctgctagatgctcacgtaaggctctacgctacaaacatataacttactattgaagaaaacgagtacgtgcctagtgagccagcagatg

SEQ ID NO: 5802 - DNA, 217 bp, Bacillus thuringiensis
ctgatgcgcctgcttattgccaagagacaggctggagagttcattacgatgactattacgtcgccgtcgataataaggcagatgacgactctactagagaagaagataccgatgatgaccgaactgaagaaaacttgtttgtctacaccttagagaatggttattggggcaatctacagtcaaatcacggtgggataaacggtacgcaaattgatcc

SEQ ID NO: 5803 - DNA, 180 bp, Bacillus thuringiensis
atggcggcataataccttccttttcagtacctgccgaaaggaaagaaccaggtccaaaatcaacttccacctttaaaggctattagggccatacaaggtgattaaggagatttggctcgcgttttaagagatgtgaataaagtcccgcctctttctagagcgcttattatgaatggggat

SEQ ID NO: 5804 - DNA, 220 bp, Bacillus thuringiensis
  unsure (1)...(220): unsure at all n locations
aaacaaaaaagcgcgganagaaggaaagataccagcagctaanactggagaagcgccnaanaanaaaggggaaaaanactgagaaaagaagccgacaacaagaacaagggcagcgaaagcgacngcacaaccgaaaacaagaaaaacacccaaaagaaaagggaaagaaacaacagccgggaaaaaagcaaaaaaccggcagaagcaacaacaaccacca

SEQ ID NO: 5805 - DNA, 330 bp, Bacillus thuringiensis
  unsure (1)...(330): unsure at all n locations
aaagggccaaaagggaaacccggggaccaatccaaggggaaaacccaccaaacccaaaccnccgaaaaaaaaaaaaccgaaaaaaaaaaggggcccgcccaaagaccaaaccggcccaaaaaaagccacaccaacccccccgaaaaccccaaaaaaaaacccacccccagaacaaccgcccccccaaaaaaccgaaaccgaaaaccgaaccccaagggaaaacccccaccggcaaaccccgaaaaaaccgccaaaacaaggccccaaacgcaaaccaaaagaagcgaaaccgccaaaggaaaaaaaaaacaccccccccaaaaagccaaa

SEQ ID NO: 5806 - DNA, 299 bp, Bacillus thuringiensis
  unsure (1)...(299): unsure at all n locations
taaaaagaaactttatgaacgctacttccacacgcacaacaaccggcgaaccaggggcaaataacggcggagaaacagacagaccaaccaaaacaagaaaaggaaacaacaaaagagacaacaaaaaaccgaanacgggaacacgaacgggaaccaccgannaagacacacaccccaacccaaacaaacgacgcgacacaaacccaacaagagccaacacgcagncaacaccgcacggggccgggaacgcaaaacccaaagcgcaagcagcaccaggaacaaaaacacgcaaaacagca

SEQ ID NO: 5807 - DNA, 129 bp, Bacillus thuringiensis
gcgcaaacacggccccgggaccactctaagctccttctccaatacaacacgagccgagaaacaaacacccttcaccaatcgacacccgtaaccccatccataccctaagtaacccaccggaataaggaa

SEQ ID NO: 5808 - DNA, 281 bp, Bacillus thuringiensis
  unsure (1)...(281): unsure at all n locations
cccaagacaaacaaacaaaggggggaccataggagggaggagaggcgacgagccgcaacncgccagagacacagaaacaagagacgaccaacggcgaaaacaaaggaaagacccacggaaaacaaagggcacgcaaagagccaaccaccgaaaagagcaacaaggacaagaaggccgcacagcacagaacaagcggacacaccggcggaaanacccgggccgacagaagaaaacggaggggagagggccaccgccagcacacaaaaaaaacgcagggcgaa

SEQ ID NO: 5809 - DNA, 165 bp, Bacillus thuringiensis
aagctatatccaccaaacgggaaagaaacatatactggattattttccaaccgcagtctgagcattgcgggggcagggaccgctccgcgaatcacggaggatacatacagaggtaacaaagacaggagagggggcaggtcaacaaaaggcggtgataaagttacc

SEQ ID NO: 5810 - DNA, 259 bp, Bacillus thuringiensis
ttacacgaagctacgggatatccccagcacctactttttaccacaaagccaggaccctgcctataacctgtatacggaccaaatgctcgcttttcaacataagctacgagacactgacgagagtgactataactaacgctcaggtcatatgcgtcactgccctgcaggactatggagcatcctggcgttcccatatgagagctgcgtcgtgcggtctcctgtctcgacactgccccttaccatatacctgatcttcttt

SEQ ID NO: 5811 - DNA, 385 bp, Bacillus thuringiensis
tctgttttgaacctcaggagtagatacctgtacactatactccggcttcaaatgtgtccctgggtatgctgggagcgcaacagatcgatgctgtccacctgtacatacgaatgcaacttcacgtggacctttgtcttctcagataccacgagggggctttggggtggtcccatgcgtcagcgtttgttcacacttatgaagttgattttaaatttactggtgaccaagctgctgcgtcatatagtgctgctgacgggtactcgcgcggaacggcctattgattgttgtgaccacgatcataaatggctgattcagcatcagctggtattccctactttagttctcgtgtcatgacatgtacaccttatgcttgactagtttccgc

SEQ ID NO: 5812 - DNA, 163 bp, Bacillus thuringiensis
gttacgagtgaaatcaaggaccagctgtatgaaagaaaaagattgtactttcgaataaatatggtgctgaatatgcatacggagttgtgacaagcgtcatcgctggtacaatgctacaaatcaatcattgacgctaaaaaagtatgtgtaccacgtgcaatca

SEQ ID NO: 5813 - DNA, 558 bp, Bacillus thuringiensis
tgaagtgcaatcatcaagtgtagctcttaatcctagtaacaatcctagatttaaaaaacaaggttatcttgaagcggccccatacggtattaatgcgcctttcgcctggggaattcaaggcggtaatggaaatggtatcacttttgttgatatggaatacggatggttattaaatcatgaggatttattacatcaaaaaattgagttaatgtctggaagaaatatagatcagcatgtcggtcatgggacgtctgtactaggaattgtatcctctgaggacaatgaagttgggaatattgggattgcgccaaaagcgaaagcaaaggttatctctcaaataagagataatggacagtataatacggctgatgcaatattaagcgctgtaaatcagttagaagctggggatgttttattgttagaggcacaagcatctttcgatggatatggtgataaatatttacctgttgaagtacaaccagatatctttgatgcaattcgtgctggtacagataaagggattggaattatagaagccggagcaaatgggtggaatga

SEQ ID NO: 5814 - DNA, 205 bp, Bacillus thuringiensis
gcggtcgctgctggcttgcgcactggcaattgtaaacgtatcgatttagtctaaccgaacgattacgacaagaatacagagccaattaaataaacgattacacaaagtcaaacaactcacgctactgttacacgtaaaaacagctttacaaaaggcggttttgaattaacaaaactggatgctgctaatgaaaagggaacacttg

SEQ ID NO: 5815 - DNA, 327 bp, Bacillus thuringiensis
  unsure (1)...(327): unsure at all n locations
gacgaacagcacaagaggcagcggggaacaacgggggcgcacccggagacgcccccaaaaacgcngngcangaaacgccacnncaagcaggagnccnagaagacggcgaagaagccaacgnananaaccacgnacaaaacgcagcngaagcgaacagnacagcaacnnangagaaaacangangcaaaggaaaacgcgaaaggcaacgcaaanagcgnagcagaagaaaacgnggaacaaggcgcacaagngaaacncggagcagncgaacaaacagcaaaagacgnaacaacggacgccaaccgccgcggcgaagaaggacgcgac

SEQ ID NO: 5816 - DNA, 289 bp, Bacillus thuringiensis
gaggaaaaacacgccgccacatcacacccaacaaggccaagggacgccgcaaccgcgaaagcgacatgaaccgcaaccgccgaggtacgggcgagagcgacgagacaagccggccggaccgacccatgccaggggaaggtccgcaactgcttgtccttcccaagcaacaaaccagactggcgggcgacaaccagagaagcatcggatgctgaacaagcccgagcccaaccgagtgcccatgcacttggtacgacacgccaaaggacagagcccccaccgccgacagcga

SEQ ID NO: 5817 - DNA, 270 bp, Bacillus thuringiensis
gcgaaccaatttccggtacacaactacatgcaactatttcttattaagtacatcagccgaacattcccgagcagggggtgctttatgctaaattcagacaaacataaacactctatgatgcgagcagccagcccgacaatatctgttctcatcgtattaaaagacctaccgagatgccgcgacggctacaacattccttattaataagcgctatttcttgtacaaccctaaatatgattccccctgtgctcctattttgcacctaaactc

SEQ ID NO: 5818 - DNA, 185 bp, Bacillus thuringiensis
ttgggacagttaatcgtttcacacttgatttgactgattgttatatgataagaagcaagtatcatatatagaaggcactgagtgaagcactctatatattcactagataggatgcaaggaaatcaattgtatacatcatcaatagtggggatgtactacatctgctgcctctcaatcacagggaa

SEQ ID NO: 5819 - DNA, 404 bp, Bacillus thuringiensis
ataacgaatcctgcatcccacacggagaggctgtgcgcgattcgtgcgctctagctcttcctatatcactgactctctgagctcggcctgaccatggccataagcggtatcagcgcaataaagggctgcgataacgatatcaaacaacacacgagacgacaccagaaagagcatagcatcaggtggccaacgaagaggcctagctcacattaatggccgtgtgcttactgtccgttcataagctgcgacacctggactagcatcacacattaatgaatctcacaacgagcgggagaggccgacaggacatatgagcacaccagccgttcctcgctgactgactccttgcgctctgtcctgttgctaccgtgaccgttaccagatacctgtccggctgtctcact

SEQ ID NO: 5820 - DNA, 143 bp, Bacillus thuringiensis
cacaattcaatgaccgtaaatttttttgaccgagcagcccactcaggggggaccttaaagaaagctttcacctacatcaaaatagaaacacgttcctctcccaacgcttaaacaccaaatggcttatcgctacagcatggaca

SEQ ID NO: 5821 - DNA, 210 bp, Bacillus thuringiensis
tcgtagctcacagacgggttctattctgggagcaagttgcggattgcggttacccgtcactcatactgcggagtgcagataatcacagtacgtgtgtgcagccttgatgctaacacgtgagaccattgagagtgaaaggacaacaaccgttctagagacgttggctcagcgtatttctgtaagagccgcccaccttgggagcgttctctg

SEQ ID NO: 5822 - DNA, 546 bp, Bacillus thuringiensis
ctagactaacggagctgcaagctcctgggaaccaatcattcatctcccactatgcgtgtcatacttcttctttcaatgtatataccctatctcttttctcatcatctttgataaaaataagttttccttctgtaacaaaaccttctaatagtaaacatacttgtccatatgctttaggcttattcgtagtgaatctttcatcggctattttaccagatcgtattaatcgttcacatagctcaagcgcacttatttcttcagaatcaattaattctaaaatatctttttgtaatggtgataaaggggctggtaccttacatacctcagctacctgcaccttttctttttcttcttcaaataaatcttcaaatgaaatttgattcattacacctgttcctttctaacaattgatttatataacatgaattgaattctataggtacgaaaactttaaatattagtcattgttatgtagtgcttacctcgttacatgaatttcaaactcatgtacatcatttcatatagtatattttgattataccaaat

SEQ ID NO: 5823 - DNA, 256 bp, Bacillus thuringiensis
ctgaatagccgaccgttttcttttctgcttctgaaaatggaatcgcacaggattgcgctgctataaaacatatcacgagtaaaaagacgccatcaataagaccaactgttgctgccatcaagatatgagccttaatcgtggccgcaacatgctggctccctaaccatattcctgttcccgcgaatatactctctggactgatgaataataacgcaaatggagtatgccgagaccaagaaaatatcaatgcactatc

SEQ ID NO: 5824 - DNA, 319 bp, Bacillus thuringiensis
  unsure (1)...(319): unsure at all n locations
caacaaccaaacagcgggcgaagcacagacgcagncgcggaccaccagaaaaaccgcaagcacnaacgcgcaaacgaccananaacccaccccaaaacgcagccccacgaaaaccccagacaacaaacgcaacaaaagaccaaaaaacacgaacaccaaggangncnggaccgaaagcaacacccccacaaacagacccaggaaacggaaaaggcccangaaacaccaancccacaagcgagacaaacncnncaaccggacacgacccaccaaagacaccgcgaccccaagaaacaaaaacacccggagaacgaacaaa

SEQ ID NO: 5825 - DNA, 192 bp, Bacillus thuringiensis
  unsure (1)...(192): unsure at all n locations
acacgtggagaaaagagccttcncgagaaaaacgaaaagaagaaaaaccggggggagttcacaccgagggagggcgcgaacgaccgncaaacgaggggagcgaancgccataaaacangggcagacgagaagccagcagacgagngacgaccacggaggagcgaaaaaggaagagagaagcgacggccacaa

SEQ ID NO: 5826 - DNA, 520 bp, Bacillus thuringiensis
gggggctataggaaacaacgcccgaaaacccgggccccaaagcaaaagggcacaggggaggaacgggccgctcccgaacgggaaaagccccccccaccaagggggggaccccccggggaaaaaacccccaagggggggcccggggggccaaaaaaaaaccaacacccacccggggggcaaaaaccccaagggccccggcgggaaaaaccacaccccaagccgccgccccggggggaagcccgaacacaccccccaaaagggcaaaagggacatcccccacgccgggcacccccccaaagccccaaagctgcccccaaaccagcaaaggggtggggcgccccacccccccgcgggggaaagggggaagaacacccaaacagaacccgggaaaaacccccaatcctacccgctgggaaaagcctaagaccggggaaaggataaactcccgccccccccgaaagggccaaagccaaaaccccgggggaacccgcgaaaaaaacaggaacacccagacccgctc

SEQ ID NO: 5827 - DNA, 288 bp, Bacillus thuringiensis
gggccatagcttttgaaatttttcaatacgggcgctaagaattttctcatgactccggcaccatgctttttatgcgttatcaatcccttgagctgcaaaatcaatggttacccattagacattgccttaattgacaggactggaacataagatcctgaggagcaagtcacagagcttcaaatttctataatgaaaaaacaaatcattaacaactttgggatcaataggatcatatgggaatccaacacctgcattaattgccctattaatacctattctattgaactt

SEQ ID NO: 5828 - DNA, 187 bp, Bacillus thuringiensis
gaaggatcaccacgaactacgatcgaaccaatccgaaaaccgtttctttttgacctaccctaacaaatccacacgcgaggcttgataacaccatcaactgcgaatccttaccttccatttgcgtgaaatgccaaacatcaacctgcgataccgctaaacgacaacttgaaaccctgtaaacatagaa

SEQ ID NO: 5829 - DNA, 279 bp, Bacillus thuringiensis
gcgtcccaaacgtagattttttttcgtacataacttggcccatgccggtgcggggaatcttcgcatgataaacggcattagccgaaccggactaacatccaccggagctaccggctttacctactgtagctgcagggatagcctagccaggagctgcaaaatgtgacttgaaggacgctgctctcacaaaccctttccgtggatcaagcgacgtgaggaatgctggctcattcgccccaatttcaactatgaattccggtaaggccggtttctcaaatc

SEQ ID NO: 5830 - DNA, 138 bp, Bacillus thuringiensis
aattgaacacgggctgtttttttatccgctcgtcccagaaacgaaatcggagggtattcctgctgatgtatgagtggaaagtgatcctggtcgtctatccaggtattcaacagaaaaccttcaagaagtttcttttac

SEQ ID NO: 5831 - DNA, 156 bp, Bacillus thuringiensis
gagtgcctatcggctcgagatgaatcatactcgctgcagatggcgaaacatgctgaagatcattatggatcacaagtgggactcatagaaccgcatctttgcagatgtcgagtgctagagatatttctcctggcataacagtgctcgaagatgagc

SEQ ID NO: 5832 - DNA, 240 bp, Bacillus thuringiensis
tatggtcattccatctatttttttactgaagtgaaaacactttgtgtcctagatactggtacccgatgtatggcgtgtctaaaagcccggcagggattatgacaagatgctgcggtaatcccgctgtataatatgggctcaacctatgtaccaaaggttatggtcaaaggaatcgaaaggctcggattggatggtaattggactcttaagagcccgtattttgttactgcatgacaacaa

SEQ ID NO: 5833 - DNA, 173 bp, Bacillus thuringiensis
ggcatactggcactaaaattctctcacagcacccgatacattatccaatccgccgactaccgcatactgccgggtctatcccgaacataaacccttactcggcgaggctgacttacccttttgtaaccataacgcactatccaagcacgtgacctctcacgtcaaatggcgac

SEQ ID NO: 5834 - DNA, 158 bp, Bacillus thuringiensis
actgagggtcagggttttttatggttaaaaatatctggagtgaggagagtgatgtcaatgacatatttatgacataggtgcaagtatatggcactaaccgattatttactaacaaatacccctaatataatccagattggtctaactcttactattca

SEQ ID NO: 5835 - DNA, 475 bp, Bacillus thuringiensis
  unsure (1)...(475): unsure at all n locations
ggaaaagcccggcccccaaaccaaaccggggggcccaccgccccaccctccacccccgggtgaccaaagcccaagccccggggaaaccccgggggccccaaaaggaggaaaaaaccccccccccccccccgaaaagggacaagggccccaaaaaaaaaaaaccaccccggaacccacccgggggaccccccccaaaagggggcaccccgcaaaaaacccgnacagcagacccccccagcgaaaaaaaaaaggggaagcccccccaaanaaaggggaaggaaaaaaacccccgcccaaaggggaaaaaaagggnaaaaaggcccaaaggccacccaaagggggccccccgggggggaacaccccgaaaagcccaaaaaaaccggcaaaaaaggggccaagccaaaaaaaaaaaaaccccggggggaaaacccgggcccaaaaaaagcggccacccaaaccaaaaaagggcccaaaa

SEQ ID NO: 5836 - DNA, 120 bp, Bacillus thuringiensis
  unsure (1)...(120): unsure at all n locations
taaccacttctaactctatnagtaaaacatnaangaagcaccttattaantgttgattacattaaaggttgggaaacctgcttatactcataaaacgtgacgttttggcggggggaggaa

SEQ ID NO: 5837 - DNA, 287 bp, Bacillus thuringiensis
gcattaaactgaggaatgcgtactactaaaacgctaccgtcaataaaggaggggccgttacgaatactgactgtccctacaacagccatggcctacggattccctgtattcgatagaggagttgtgtacctacacacgtcaccaatcggaacagaagctaaatcaacagaattacgtgaaacgacgacagcattattcatgcgaacaaaaacaatattgccagtagcatatatgggaaaaggtgcgaagacatgaaacaaaatagagtcatacactacttaagcggt

SEQ ID NO: 5838 - DNA, 244 bp, Bacillus thuringiensis
caagaatataagcgattcccttcgtttgaggtgtcggtcgcgtccagggggttgaggacccggagctactgggaagatctctgctaagccatctccagacgatagacccaaatcccgaataaactgtggatattataataaatgggcatccaacgcagtatcaatacaaacagtctcagtaaaaatcacttccatcgcagagtccctaaataccccataattgccgcaaattgcgcactgaaca

SEQ ID NO: 5839 - DNA, 377 bp, Bacillus thuringiensis
aaaatagaacgactgccttgatatagaccgcgacgaagtcgaagcggtacgcggcgagacatccggcttaactccaggagaagatcgcagaatcagcggggagactgaaggctgcaagagtgaaatggcacaaacacgaatgtctactcgtggacgctccagacacagagaaagagggggaaacacattgctacaactgaaacaggcctacgaaatctgggaacacatggcgaactcttagaggaaatcaaaatacagtcatcaaacaagacgccccgacatcgatagattcagacgcgaaaatactggcacatatgtacgcaggaagtattcgtgattttagagagcaagcgagagacgcttacctaatcgagggc

SEQ ID NO: 5840 - DNA, 205 bp, Bacillus thuringiensis
  unsure (1)...(205): unsure at all n locations
cgattattccagctcccttacatgggaaagcgaccaaagcaanggcaacggcccgcccttatgaagaaggagcgaacgaggngnatccgcnaganaagaaaggggaaacgacaggccaaggaaaaaaaggacacncacaagaagaaangacgccnggccaagnngcagaacaagcgaaacaaacaacagacgngaagggcgcaag

SEQ ID NO: 5841 - DNA, 180 bp, Bacillus thuringiensis
  unsure (1)...(180): unsure at all n locations
ggggacacaccagaagaagaaccctccctaaccaaagaaaaaaaaaagcanaaaaaagaacacccaagaaaaaaaaacccccccaacccccccaaagaaaaaaaaacaanaaaggccaaccaagcagaaaaagacaaagagccaaaaaaaaacaaccaaacaacaaaaccaccgaaaaaa

SEQ ID NO: 5842 - DNA, 401 bp, Bacillus thuringiensis
agagggaccgtctactgatcatagatagacgctataaaataggcgctcgatactcagggtaaacaactacataccagcggcctgtatcaaatgaatctaaagcaatcacatcaactatacttacaatgattacctaccctggtattaatccctcagtgatactagagggctcgccttggtcaaccgcatacactactagctgccaacacactacttaggtaagcattatcatcttcatgcactaaatccgctgatggtagaacggctaaccccatcggctcgtcagtgatatacatccctgctgcgtggacaacagtggacacatgtccatctccaagtctatggagtgcgatactgtctgtaccaaccttatctgtttgtacaactctgctttacacgga

SEQ ID NO: 5843 - DNA, 435 bp, Bacillus thuringiensis
  unsure (1)...(435): unsure at all n locations
aggggaacgaccccgcacgggcgcgcaaactttcgggaagctgcccagccnggcagagcaccnggggggggaccagggggacgcaggaacaaaacccgncgccccgacaccaggngggggcccaagcacagcngggagagcgcccgccaagcacgcaggaggacagcggcacgaacccgcaaggcgccaccaccagcacaaagaaaaccgaacgaccacaaaccccaagaaccggccaaaggaaaacgagacgcccaacaaacgacacgaaagggagaggccgaacccggcccaacaagaacgcaggcagagggccaaacacaggcaagccgagcgacaggaccaagagcgggcccccaagaaaccagcggcgaacggccgagcaacacggggggaacccgccccaaagacagggacaacccccgcaaaccgggg

SEQ ID NO: 5844 - DNA, 297 bp, Bacillus thuringiensis
  unsure (1)...(297): unsure at all n locations
ggaaccggacagaagattccaaccttcgacgagcgngacaccacgaagccgggggcaagggggacaacggggcgcaaaccangaacgggcgaacaacnnacccgaacnncccggcaacaaaaaaaaaaccggaaggaggcggaaaaaaaagcaggaccaccncngcgcccgggcccccccgccggccggggaaaagccgaaaaaaccggagcccgggagcgggggaaccgaaaaccccgacaaagcccgggagcccaagcgagccccaaaccacacgagagggggcccgagcccgcg

SEQ ID NO: 5845 - DNA, 325 bp, Bacillus thuringiensis
gcagaggccgtgaaccatggctcctacgccctaagaatagccccacctttttggctctttttgctaccccataaccttcaacattcacagtctgacctaatggaataacatcagggtccacctactctaataacattcctgggtatgcagttaaaatataaccatcaccacctgtaccccatgcagaacatactagtagccagctgcataaccatcggccactggatcaactgaatgagctgccgccaaatctcgactttcgtagcgcccctctaatgacaagaaaaaggggtcccgaagtgcctgctggaccagcgaattacta

SEQ ID NO: 5846 - DNA, 511 bp, Bacillus thuringiensis
ggggtaaaagcaaaccaccgcccaaaaaccttgcccaaaaatcaaaatttgcccaaaaaaggacctgggatgggtttggcccgggcaaaaaaaagaaaaaaagggggccccagggtaacctttccccgggattttaccccccaacctgggaaaaccccttttgggcgggcaaagccgaaaattcccaaaattttttgggctaaaaaaaaaactcggtttttttttccccgggctaataaaagtaaaaaaaagggtcccccccctaccttttcccggcattttaaccccaaacctgggaaaaccccttttgggcgggcacaggggaaatttcccggaattccttggcctaaaaaaggacctcgctttttttttccccgggtaaataaaacccgaaaaaaaggtttaaccccttttttttcccggaaggttaaacccaaagcccgggaaagggtttttgggatccgccaaaaagggtttaacctttgggttggggggggccacaaaaattttt

SEQ ID NO: 5847 - DNA, 331 bp, Bacillus thuringiensis
  unsure (1)...(331): unsure at all n locations
gagacacaacgaaagacatncacgaaggccttttagcttcaaaaacggcaacaaaccagctggaggtagcggaacaacgaaggacacatgagctcatcgaaagaaaggactgcttcaactagcacctcgacttcgaccgagccaggacgaacgcgaacagctgctcgaccgaatgattccgcatctacgatacccacacacaccatagataccgtatacgctacagaacatgacgtgaacaaacatcctccgtttctaacaaaacagggctaatgaccagatcatatggcaacacagcggttcaagcgctctatcaacgacccacttcaac

SEQ ID NO: 5848 - DNA, 282 bp, Bacillus thuringiensis
cgaatcacggatgcgctctaagatatagggagaaacagaatccacaatactggtctgtagtggaagaagaagacggttaagtaataaagagctttcaaaagaaccagaaggacatgctctgctaattcaaggacgttttttagcaataccgccattccttcaatgacttctagagaaagatacgaaaatgacgcacttacacgaaacgagccaaccgcacgctctttgcagaactgagcaaccgggacttcaaaagagcctgataacccttgtaaaccaaca

SEQ ID NO: 5849 - DNA, 258 bp, Bacillus thuringiensis
  unsure (1)...(258): unsure at all n locations
gggcacgactcccacaacgcgaatctttcaaaagttcccaacagagagagcaccgaaggggaccagggggncgcaggaacaaaaccgggcgacccgaaaccagngggggcccaagctcactgggagagcgcccgccctgcacgcaggagggcagcgggncgaacccgctaagctccaccaaaaggtccttgaaaaccgaacgaaacaaacaacgtgaaacggcaattgctaagcgagaatgctagacaaaccaacctt

SEQ ID NO: 5850 - DNA, 162 bp, Bacillus thuringiensis
tggaacgaaacccgaataaatagaaaaaacggccacgaacaaagggcaaactgtactgaggcagggatacaaaccggaggggcacaccataaaaaagaagataaaacaaataaaaaaagctgaaccaggaaacagcaaaggaaaaaaagaccaccggggaaa

SEQ ID NO: 5851 - DNA, 445 bp, Bacillus thuringiensis
ccccgccccctcaaatagggtggccccccccctttttggccccgggggggtttttttttgaaaccccgggttttttcccccctggggccccggcccttgggaaatttttccttgccggtttaaaaaaaattggggcccaccttttgggggaaacccccccttgggcgggttttcccctaaaaggggggggacctttttttgttttttttttaagaaaaatccccccctttttcccccccccatttttttttatttcccccccctttttttttttaaaccaaaaccccccccaatttttttcccggcccgaaaacctttctcgggaacctggcaagaaaaccgggttcccccccttttttttaaaaggccccttccgtttggggggacccggaacccctccccccgggggattcctcttcccaaaggggtggaaaaaggaaattgg

SEQ ID NO: 5852 - DNA, 108 bp, Bacillus thuringiensis
ttcttaccaactatacagcagtggaaaaatgaatggggaaatccacgtattataagtgttgaagcaaaactatcctcaaaatttttatacacattgatttcgaaaaga

SEQ ID NO: 5853 - DNA, 160 bp, Bacillus thuringiensis
gaaactagggccagcactaacgtgtactcaacaaaatcacctttttactgcgacaacatttctaacatcttaactgggggctcttttataaaaccgaacaagagattcccaaagcaccggccggaacattagatcataagaacctatgttgcccacaaga

SEQ ID NO: 5854 - DNA, 451 bp, Bacillus thuringiensis
gacagtgcaatagttcaattggtacaatgaaaatacatactgctgccactgatgcttaccagtgagaagcgaatgaagcgccaataagaatagcgctatcatgggcggaacacaaaccggctgccattgtactcgggctctttagtcttgggatccaacatcttcccataggatcaaaggcttgtgacattatctcaccgtggccgagctatgatgtatctacactgaaacattcaggtccaaaactaataacaaatgcagcaaaagacatggctatgaagttatcgttacggaaaagatgaaatcacttaattgcagctttataaaacattgggatggatgagagttaacgtacatacgaatgataattaataaacgaaatatgctatttctctcaattttatgacgatatcaagcttttaaagagtgacagcacatgcgcataacctta

SEQ ID NO: 5855 - DNA, 430 bp, Bacillus thuringiensis
caccccgggctttgaattcaaatgccgcttttgggggggggaaatttggggggggtgatttttggaaaaattttgttttaaaagggcaagggggacctttaaaccaaaattttaatttttttggccccaaaacaaaggggggttaccgcccaatcgggaaggggccttttttggggccaaaccggggaaaaataacttttttttgggggggcttggaaaaaagaccttttaaaaacgttttttggaccgttttttgtttcccccctggtttaacccctaaaaagggcgtttttttccctttttttaaaaagtttttttagggggtctctggagtttttcgaaaatttcttaaaaactttgggggaaattttggaaaaaggggtttttttggaaaaagttcccggtcaaaaaaaaaaaaggggcccccatt

SEQ ID NO: 5856 - DNA, 126 bp, Bacillus thuringiensis
  unsure (1)...(126): unsure at all n locations
aaataaccacacgngngggggcccgagcncgcggcgagggaaagcgagagggacacccaaagggccgcacaaancaccgggccgacgaaaacaacgccgagaccgggaaaacccaggcgcaaccca

SEQ ID NO: 5857 - DNA, 208 bp, Bacillus thuringiensis
cttgatgactcaacattcttttgtagccgaggctagaaataaatgacacgagtgggggaccagcctcgtgggggttgtactgtacatagtcagcaaaatgatcatacacttcactggccgtttgaatacaacggagacactgctaaaacacagcctcaaccgaacttaatctgcttggagcgcatattaatgttgtcgaatggcgatc

SEQ ID NO: 5858 - DNA, 160 bp, Bacillus thuringiensis
acgcgcacaacatactgacccgtgttgttttaattggggggcaccctgcggggactttatcgacagccttgctgggccaattagctacaactctccaagaattgcaaggagcacaatatcatcatgacaacaacaggatgctatcaaaacgcgtaagcaa

SEQ ID NO: 5859 - DNA, 292 bp, Bacillus thuringiensis
taaacgggccccctttcttctttccgaaagccggggccttttctataaccacaccctgggggttttaaattcgggggagggcgaaccttcaaaacggggtttgtgacaaaaaccccccattaaacccaacccgtgccccttaaccggaaaacatctctttgggggccaccccgggaaaaacacaattaatccccctgggaagcccccataaaaaaaaatttggaacccattcttaaccccgtaaggacatttgcgggacaccaaactttcccaaaaaggaggccaataaaaa

SEQ ID NO: 5860 - DNA, 450 bp, Bacillus thuringiensis
agacaacatggaatgcctgatatcaatgcaaaacgaacttcgtccctagaaacagaagcgaaccataacatagaggggtacgtaacagaccaaacacggaaaggagcccttgaaaccgagagggcacacgccctcgccccaaagcaaaagggacaccgcgccatggacgctcacaaagcccagctccaacattaaaaacaccaaccaagccattgctgggaagagccctatacatagcgcctactagcagagaacgactccctacagtatagaaaatgactacgccaaacgaggaaagccatacgcaaaaaaagaaaccgcgccacaccaagaccaagcgcacatgattcatgaattaacgcatatctataaggacggcgaccttgagaaagtcgctcagaccactaagggcacgtattataaccggatggaacaagcaaaacgcgcaca

SEQ ID NO: 5861 - DNA, 469 bp, Bacillus thuringiensis
ccccccgcccccggataaccatgaaaacctacacagccaccagggggggcaatatttactgttaatacagcgtgcttcctaccctgcatagggtaacaggtactagactgcgccttacaaacaggagaaacgcttctcatcaaatccacgagccactacgatgtgtacatgctcgaatgcttcttaataaagcgctctacgaccagccaatacagccgaagggatcacaccaggtggatcgtatgtgccaagcactgaagggtggatatagaatgcaccatcaatcatagtgcggcgacgtattggcactatcacatttataaagaagaacccaatttacgcgcttctcgaagtgcatcatgatagacattaatgaggaattccaacttgtgtatcaaaacgattactgagaatcgcatatgaaaactcggtgatgattacaatcgaaagaaaaatgaaaattttatca

SEQ ID NO: 5862 - DNA, 183 bp, Bacillus thuringiensis
cgcatatagctgaggggatttgtttatgacaagctgggcgcctgtaccatcatcgatagatacagaaaaaaacacaccatctgatggcgacatctgaaccatcaacggaacatgagcacttactacaatacgatattttgactgacgcaatctcagggggagatacgaaaagaaactggtatg

SEQ ID NO: 5863 - DNA, 135 bp, Bacillus thuringiensis
aaaatcccgcccacaaaaggacgaatgggggggggaaatggtgggaaaggactctgaaattcctccaaggagctcaataggcgaaatattcaccggaaaaaatactaacttttaccggtatttaaatgcgcctac

SEQ ID NO: 5864 - DNA, 317 bp, Bacillus thuringiensis
gaaagtactcgcggactcctgcatacatactgagaggatgacgactgacatccatgtggtgcaaggaaatactacccgtgtatttacaccctctcactctgtactaaatactgcctgtcaattattgggagctattcctaacacgaaatgcatgcgctatgacacctactatccctatgttgaaaatgattataacactgaagtaacggggtctattctgaataaagtttgaatgcgatttgcgctgtctgataacccccacgtgcgggccgttcatatattctgttagaattcaggtgactccttagagcaagctg

SEQ ID NO: 5865 - DNA, 314 bp, Bacillus thuringiensis
gccgcatcggccgccgtgcgagagggacgtgtaacacgggtcgctcaacgcggcacgacatcagggccaagcctgggggtacttttcaggcaccatgctcgaagtcggaccaacaacaaccgatatctaaaaaagaggcaccccttcgtaccaccggaccaatttcgcgttttgcatggatatacaatctcacacatacctacatagatcaaacgctagacctcagctgattacaactaagctaatcaaaactatcgtctaaaaggtttccatactcattccacaacgcccttttcatctgctgacatcggtaa

SEQ ID NO: 5866 - DNA, 143 bp, Bacillus thuringiensis
ccgcgccgcggcgatgggcggctgttattcatgggacgaacgaaagcctgaagcccgaaaaagacaacgcggcatgacagcgatgtcatgccgcgttgcgcgacccgtgttgcacgaccctctcgcacggcggtcgatgcggc

SEQ ID NO: 5867 - DNA, 420 bp, Bacillus thuringiensis
taaaaaaaaaaaccccccctgggtggtttttttttaaaaaaaccccctggttaaccccaccaggggggaacacatttcccccttttggaaaaacccttcccttgaaaccccccttattcccccctcccttggttaaaaaacccggacccattttttttttttccccacccttaaaaaaaataaaaggggaatcccctttttgggccgccctttttttttttggggttttttaaaaaaatttttgtgtttcccaaaatttaatttaaaataaaaaaaaaaaagggggggggggcttttttttttttaaggggttttggggatttggtttaaaaaaagccaaccctcttccctcaaaagttttttttacccaatccggggggcccctttttttaagggggaaaaaaaaaactttttggggtt

SEQ ID NO: 5868 - DNA, 311 bp, Bacillus thuringiensis
  unsure (1)...(311): unsure at all n locations
gaaacagagcggaaccagaacccgngacacgacagagcgccgagggcgaaaccgcaaaacattttgggactctttagagaacacacgccgaaacaaggagggaacaggcgcaaaaaggaacaaacccccacgaacaacgaacaacgccagcaagccnccacagccgacggaccgacaaccncagacgaacgagaanaagncagagcgcacccaaaaagcagccaaaagcaacgaacaaaaaagcgaggcggaacaaacaagaagccnaacaagcaaaaaggacgacacagcacgaccgaacggggcaaaaa

SEQ ID NO: 5869 - DNA, 198 bp, Bacillus thuringiensis
  unsure (1)...(198): unsure at all n locations
aacccccagaagggaaataagaagggcgcaaaaatccgacctgaacgaaaagccgttcataaggnaaaaccaggagcgcatgaggggggaggacccggcacaaaacaccgcaccaaccaaagtaacaccctctaaaacaaccaaggccaagatagctgagccacaaaaaagccgtcccgggcccgccctagaaagaac

SEQ ID NO: 5870 - DNA, 342 bp, Bacillus thuringiensis
cggttccgaatccgtgatgaaaataacgagattgcaacgaaaccgctcccaaaaccagtgttagcatattctaccgccgccagagtctatcctgcacgtgagggaacgcaatcaagatgattcctcacaaagggctctacgcttgcatcaaatacgactagcacgcctgtgataagacatcagtgaagctgtagctgcgcgaagcaaatgatcgtccccctgtgaacagcagacgctagcactcgagcttgcacaggcggaccggacaccaccgaagttgttggcgctcgcggaccaggacgtgggggtgctacagtctggtaaataccgcgatcaaccccc

SEQ ID NO: 5871 - DNA, 168 bp, Bacillus thuringiensis
  unsure (1)...(168): unsure at all n locations
acgcagaggcggccaatcagatattacacccaagcagggcctcccgcaggaaagaacacaagcggaaaacgccgggcgggggccccagccangaaaagacagggacgccggcaaaaaaccagaagcgccgcacgaaagagaagcaaaagaaacgcacacaccccaccc

SEQ ID NO: 5872 - DNA, 181 bp, Bacillus thuringiensis
  unsure (1)...(181): unsure at all n locations
aaaagagccagggaccaggcaggacgccggggacccagccgcgcaagcgcccccgcaaaaaacaaaaacggcggcggagcngcacaaaagggggcngggaagaaaccagaagcccgccgcgccccaacaaaaaagaaaccaggcgcaacccccaggaagccccgaacggcgccccccagaa

SEQ ID NO: 5873 - DNA, 135 bp, Bacillus thuringiensis
  unsure (1)...(135): unsure at all n locations
ggcgccaccccccacaccggggccaggggcaacgacaaacacggcagcggccacnaaacccgccccgacaaaaaaaacaccacgcaaaccccccaggaaacacccaaaagcgcaaaccagcaccgacccagccgg

SEQ ID NO: 5874 - DNA, 124 bp, Bacillus thuringiensis
tgcagcatgcgtggtaccggggttgcttatggagagtcagaggggggcttttatcaatcatggggataagctgtttactgagtgaaaccggatgccgataacaattccacacgagatacctgcc

SEQ ID NO: 5875 - DNA, 100 bp, Bacillus thuringiensis
  unsure (1)...(100): unsure at all n locations
gaacaacccacaggcacgccacaacaccgacgggacagggaaaaccccggcgaaacccaagacaaacaccaaggagcacagcccccnaccgccagcgggc

SEQ ID NO: 5876 - DNA, 235 bp, Bacillus thuringiensis
agggggattatgaagactgcggaaatatttgtaccacctgcttttgctttaagaacaatgagtgatgctctaacagtatctgttgtagaggagagcctataccagattatggaccgtgtgcgatgcctcatgtatccagcccttgatccagaagatattcctgttactgagattttgggacgcgattcattcaactgctactgctactgagcgtgcagcacaagacgcataccac

SEQ ID NO: 5877 - DNA, 141 bp, Bacillus thuringiensis
caaaaacggcaggagaaacctaccaacttgggataagaaattatcccattctgataggaaaacatttaggacgctcaaatcttattgcgacgaaccaaaccaaataatgtacctaccggaacaagacatgcagcaaaaccc

SEQ ID NO: 5878 - DNA, 229 bp, Bacillus thuringiensis
  unsure (1)...(229): unsure at all n locations
caaacagggaaggcgaagcaaccggcgcattttcaccgtctgcgcancagccaaccnccacacagaggagaaggggcgccaaggaccaggaaagcaggttcccccgggaaagcaggggcagcgaacaacacaagaaccggaagccagggaaaaaggccacaggaggagtgaggcataccagaagcacgccgaaatgcctagaaggacaaagccggcagaggaactcaca

SEQ ID NO: 5879 - DNA, 285 bp, Bacillus thuringiensis
  unsure (1)...(285): unsure at all n locations
tattatacacttcgnagccggacatgggataatggagatcacatcncaacacaagggcggaatgtcacgaaaaagagcaacgctatttctatcgaagcaaaagctcccaaagaaaaaagagaaaaatggccgcccgcctgtcatgcaggccggaccattatttgggcaccctagttgatccgacctgcatcagccaattaaaaagagacgggaaacaaggataaatatatgaccattcactacaaaagccaagagtgttgccataggatcacgcaacgatgaatc

SEQ ID NO: 5880 - DNA, 145 bp, Bacillus thuringiensis
  unsure (1)...(145): unsure at all n locations
caacagaaaccggccaaccggggggaacgggggaaaccacagggggggagccngaaaaccnacaccncnacgagggaacacggcaaaagaagcgccagcaccaaaaaggccagagggacagcaaggcagnccaccacccaccgca

SEQ ID NO: 5881 - DNA, 142 bp, Bacillus thuringiensis
  unsure (1)...(142): unsure at all n locations
acaaacaggggggaaacgggggggnaatagaaagatgcctcccaaaaaaagagggaaccccaatacagagtgaaggaagcaatacagctaatggggaaagaaggacaaaaaatggagcataactcagcaaacagaaaaagca

SEQ ID NO: 5882 - DNA, 310 bp, Bacillus thuringiensis
  unsure (1)...(310): unsure at all n locations
aaccagaacggcacgcaaaacacgtaataagtcgcacattatatgaaggaggacgaagagcttctgacttcctnannnangganagaggaccccaagagcaacgggggccgtagcacagacagagaagccaaaacacaaactggagaaaaaagaaaagcatacgcagcaaacgaaacaatgaacttactccaggaccatatcatcgaggaccaaactaacgatgtacaaactaaaccagcgagtataaagccaaacgggaaaaatgccgggcgaaaccaagcactactgggccaagcaagcaggcatacc

SEQ ID NO: 5883 - DNA, 173 bp, Bacillus thuringiensis
  unsure (1)...(173): unsure at all n locations
gacaaacaggaagcgccagcgaccggcgccttctcaacgctgtggcggccccaacacgcncacccgggggacgaggggggcccaagaccgggaaggccggncccccggggaacgcaggggagagnaaccacgcagcaacaggagggcgggacccaacgcaagacggccggaag

SEQ ID NO: 5884 - DNA, 111 bp, Bacillus thuringiensis
  unsure (1)...(111): unsure at all n locations
cagaacgcgagacagaacccgcgaaacgacgcagccgacgagccgaaaccggcaaaatttctgagaattttaaagaaaagaccgangaagggcggagggcagggggagaaa

SEQ ID NO: 5885 - DNA, 227 bp, Bacillus thuringiensis
  unsure (1)...(227): unsure at all n locations
aacgcccacagcgaccaaaagtgagccagcggacgcccccgcacagacagggaggccaactgaaaggagaaccaccgcgagagacaagcaccgggaagaagcaaaagccccaaacggcgcaaacgccgcaanccaccgcncaaaaccacaccgcccagcacggaaaagagcagccgcaccccaaacggaaagaaanacaccgcgcaaacaaaccacggcgagcccaa

SEQ ID NO: 5886 - DNA, 189 bp, Bacillus thuringiensis
  unsure (1)...(189): unsure at all n locations
cagtggatcacaccacataataactactggcaaggncaggaaaacaacgggggcgaacatagaatccaccttccccgaagccatcaagacccaaaagangtgataacaactcttctgttacagaacgctgtgattataaaggaacaccacctccaaaccctcaaatcgcgtactcctggagtaacagct

SEQ ID NO: 5887 - DNA, 311 bp, Bacillus thuringiensis
caaatgcgtacacaatgagtacataccgccagagaaacacacaaacaccctagctactgttagagacaaaacccccgttgactataaaatatacctctaacaactcgaacttctttttttcccaccattttggctcgctataactccccctactacaataacattctctcccctatcccctaaaatttttaaaaaatcactctccccaaccattaaacaaaggattccctttgctatttccaccaccatgtttatcgccatttcacaactaatgggtgcatattgcccatgcattctttacctccaaaaaa

SEQ ID NO: 5888 - DNA, 412 bp, Bacillus thuringiensis
  unsure (1)...(412): unsure at all n locations
gcgaacggagcggaaccagaacccgngatcggacaggatcacagacggagctcacaacccagtttgtgacgtcttccangngaaaacaaaagaaccgcaggacaaaggggaacacgcgagagagggaccacggcgcccggcgataaacaacaacagaacaaggcaggccaactagaaaccaatgcagacgaaaagaatgtaacaacacgcgcccaagagcgagccaactcagctgagaagctggcaacacattcacagaaagaaccacaattagcgctggaaaaccggaaagaggccatcgagacaaaaagagaaatgagagcagaaaaagaagaagccaacagaacgggaacactaaagggcaaaaccgaaggacgaaaacacatacgcgagaaaaacgagaaagccaaag

SEQ ID NO: 5889 - DNA, 187 bp, Bacillus thuringiensis
ctaccgctggtggaactttcttttttagaataaatctatactgcgcactagatgaatggatcggtggctattgatttggtgaacaggacacggctactatgataagggacggctggtgatccgacagcagcagtggcaggtactcaacacctattttggattgcgtattaaggagacaccattaatg

SEQ ID NO: 5890 - DNA, 141 bp, Bacillus thuringiensis
cgttgaatttctaaagaacacgcaaaacttaaccgggtggggtaacatttcaggcacggcgcccgacaacaaatgcataggcacgatcagaactcgcatgcacgcggcccgagtctgggctagcttgtgacctcacgtatg

SEQ ID NO: 5891 - DNA, 296 bp, Bacillus thuringiensis
  unsure (1)...(296): unsure at all n locations
ccccgcgagaagcaagncgacgatttcttatagagcaaggaattaatctagangacngaaacgaaaggcacaagggggggctcatacaaatggnaggggcgaacccagacaacagaaaccgacgggtacagagcttacattagcgagacgcaaaacactattagaactctcctgcgagtgcggcagaccaaaagacgaagccaaacacaatgctttaaacactcggaatgcagaagagaacccaacaagccgagcaagggaacataaccaacacaattgtgatcggcatggaaaga

SEQ ID NO: 5892 - DNA, 326 bp, Bacillus thuringiensis
ttcgcggcctaatacctataagaacaattgacttaaatcatcctgggtattactagacaatctggtatccaaaaacgtgatatgagagtggcatagtgtaacaggatcgtgaattggatacaaccatagcatggttcgatggtgcaacgattattttatgacatcagtaagcacatactaacgctaaagtctacttagtaaaggtgatgctcgcagcctcatcctttcaggcgctatgtaactatgcaatgtattgtgaataaccgcattagatgaatctgatattgtacgctaccagaatcagagccgtttttatacgttgcatg

SEQ ID NO: 5893 - DNA, 330 bp, Bacillus thuringiensis
gattacctaaaggatcaaagcccatcacctccgagatcattttgaagtaaagcacacactggtatccatggggatgatgcatatatgcagattgcatcaccatatacttgatgactctggactgcataatattcttttacttcatgcagaagtccaggttcctacgtatgcgcaatgttcgcataacacgcttgataagactggctctgggttttggtagtaccagtgaatatgtcactcggaacgggatcattcgcagcgacagcaacggttaacactacatcatgatatataaggcacagcgagcagattcatatgcaaataagaagt

SEQ ID NO: 5894 - DNA, 364 bp, Bacillus thuringiensis
ccaccttcgggaccccaacccatggggggccttaaaaaggcttggggggttaccaccaccgccctggcctccaaatttccccggaaacaaaacataacgggggttaaaaaaaatttggactcctgcaacaaatcgggtgttttgaaaaaccaggggaggccccctttttacccggttccctttctttaaccaaattttcccctttcctttaccaaggttaacccaaatttatccgcatatcccttttttgtggtgggcattttaccccgtactaggaaacgtgctctttctttacccaaaccataaaacctttatttggacctccaaaaagcgggggttttgaagaacacctccatatcggttt

SEQ ID NO: 5895 - DNA, 103 bp, Bacillus thuringiensis
cctttttacccaaaccctttttaaaagacaaccccgggggaagtttaaaggaatgttgcggtcgacaaaccccacgcgcccaaaccaaaaattcaaaacttta

SEQ ID NO: 5896 - DNA, 269 bp, Bacillus thuringiensis
  unsure (1)...(269): unsure at all n locations
gcgcgagaagcgggccgacgaatacagatacgaagccctgttaaggggnagnnagggcannnacccgggacgggggaaagaagnaggggggcagaaaacacgcgcccgagggagaagacncgccagaaacaacaacaggaacgccnacagcanangcanggnacgaaaccacaggaagcaggaaaggaagcgggacacgacaaaacgagagggcaagacncgaacccacaagcgggacacgaccccaacaggagacgcgaccaacaacg

SEQ ID NO: 5897 - DNA, 434 bp, Bacillus thuringiensis
cgcaggggtgagtgatcatatagggggactagagcatacaatcggattattttacaatcgtggcggattctatgatggggggggataatgagaggttgaatagaactaacaaaaaagagctcaagcatgtgggcactatactgctctgttataaaaaccataacagctgaggagatcggaggcttacagctctacaaagggacttggacatacatgtacacagtaggacgacggtcccaggagacagaaatatgcaaatggggaatgggtataatacggaagagttttacatgaggctagcactatataactcgccgcgtggacacaattggacaaacatgtcccaagtataatgttcactatcgcgaatacgcagaatacccagtgcgtaagctgttatataaaaaatctcaaacgtgtactaatcaaaaatg

SEQ ID NO: 5898 - DNA, 334 bp, Bacillus thuringiensis
gcaaggcaatcatttttccatgaaccggactatggccctgtggggggcgttaatcaataaagtgcgccaccatgacacgcattacaaaattaaacgctctggccggagttgaggaatccccaccggactctcaagacaccagatgaattaccccataagctattaggagcgcccttctgatccgacgctaatggttaccgaatacaacaccttctttacgcatctgataagcgactggctagagcatatctatcgcacgatgcgtcagagcccggtgaggctcatacattccaagatcgcttgtgttcgcacaaccacgctttcagacctacca

SEQ ID NO: 5899 - DNA, 238 bp, Bacillus thuringiensis
ctgatctgctccctttatttattcacgttgcgctttagaacaaagcggggggccacatttaaaccccgccgctggtcctgccggggcacattcaaccctgcattcagcatatgtacggattatatgatggattataatcacgtccaatcggaagtgaatctcaataatgtaaacaactttatcagcggactaaaaccgggaaagtcggtgactatctgcaaggggtgcatactaaata

SEQ ID NO: 5900 - DNA, 330 bp, Bacillus thuringiensis
aaaaaggcaaacatttttttatttaacataaagcaccaaaaagccaggagcggggttaaaatacagattaatcgctttatttcattattcaaaaggtatgaggataatagtataaaataaagaagagaatatacctgcccgactcagatggaggaaattatacataatgtagaaacgagggaaggcatgacttgctgtaagtggcccagtagctacaaaagatggacggcggctatctgttaataagaaatacagtggctgaaacagggaaatgggcttaaccgtctggctatgtaaatcaaggagaaacgggagattaagctgtgaaac

SEQ ID NO: 5901 - DNA, 224 bp, Bacillus thuringiensis
ggggtgattcgattattctttattggtgcaatatacaacatgtttccgatgacaataacgttacaagcgacaagggaggttttaaacttagttgacattgaaagatcaaaatgttaacataagttacactctaattatccaccaatctattacttagaaaactgaacgaaacatacaacgagatacgttaatttctattttagatgctatacaaactaacttta

SEQ ID NO: 5902 - DNA, 225 bp, Bacillus thuringiensis
ttccgctctttattttacacaacacacgagccccaagcagggagggggaagactgaagagcccatggagtcagctacaccacattaaaagcgccgcgctcacttgcccgctatcacagccaggtaaccccgccgagccagcagcagtaatgaatccggccaccacacaaaaaagaggcgcccgcgcgtagtggagcgcgactcacgcttcctcgctcactagact

SEQ ID NO: 5903 - DNA, 311 bp, Bacillus thuringiensis
  unsure (1)...(311): unsure at all n locations
aaaaaaagggggggganaaaccaacccaaagagagcgaccaaaacgggaacgaaagcggcgaacacacaacaaaagcgaccggaacccgcagnaaaacagcgaacacggaaaaaaaacgaccaaccgacaanaaacaacgaaagccgcccgccacaggaaagaccaaaggaaccgagccaaaacaaaccgcggcnccgggaacaccgccaacccnccgaggacaacgccaaaccaagcaacaacacggggcggcaccaaaacaaagccgccccaaagcgaaacaaccggcgaaaagaaaaacccgccccca

SEQ ID NO: 5904 - DNA, 154 bp, Bacillus thuringiensis
acccagtttccacatactaatgatattagaacaacgccatccaagtatttctattaacatcgacatagtaaaacattcctaacactgtaacaccctttagctgttcttctttcttaatttcatattgcgcaacatcatttagacgattgagaat

SEQ ID NO: 5905 - DNA, 296 bp, Bacillus thuringiensis
atgcagtgtgcaaggcccattacttacaaaacttttatttcccttgcaatgcgagaagaaaagcttacgcaatatgtacgcctaccatactacctattcaacaatgcttgttataacaaccattgtttcatatggcatactaaacacatctaaactcagcgtggaggacatacacatattacgtgcccatgtcctggccatatagactgctttactgccgtccagggattgaacgagccacccaggccaactttgcacatcgttggcgtacgatctgtggaagaggatctcacagt

SEQ ID NO: 5906 - DNA, 434 bp, Bacillus thuringiensis
gcgagaagggttatatgagaactcagggcctggtcctatcttttgaggccttgaccactgacacattacagaggggattgttacatcatgagagtctgtggaaatcagcaagtacactttggcgacgtgcgtactgcccctgtaccatagagaaaaggtacacgaggcatgctacaaagcgggacaatgaataggtatggcagaacgaacacaatagcattaccacattgaactacacctagggagccttctgctggtacgacagaacaattccgttacactggtgcaaacgttgggttcacatgctggcgatggtgaggtacggtctatcatggttacttctgcaactccaagtgacgggataacaacgactacgctacacttagtagtggttacttgaccacgaggatggcctgtttgatcgatcggagcta

SEQ ID NO: 5907 - DNA, 361 bp, Bacillus thuringiensis
  unsure (1)...(361): unsure at all n locations
ccggggcacgagaagcggggcgacgaatncagananaacacgccctccagnaaannngagccgaaccccccaagggggaaacgggagagcgaccaggggggcacaccagnccaaaacaaggaacagancaagcacggcgaacggcngncacgaaanacangaccgaccaaggccggcacgaccaggaacccacgaacgagaacggaaaccacccngaagacaacaaagagagccgagaagaaaacacaccnggagccgcccaacaagaaacaggaacnacaaaagaaacacccaaacaaagggccgaaacgaaccgcgacgcagacggaacacgcaccccccggggaacgggggcaacgca

SEQ ID NO: 5908 - DNA, 345 bp, Bacillus thuringiensis
  unsure (1)...(345): unsure at all n locations
gagaagcaaggcgacgatttcatatatacccaagaaccatcnaatgaaaggcaaaaagaacaacaaanngggggttaaagaaaagaagcggcggacaaaaccaatcaaaccaagttgcctatcacgagagaaacagatccgataacaagacaaactcaagaagaagccgcagcgacagaagagatgacagccggaacagaaaaagtaaatgccactccatcgctagcctcggaaactgcaacggaggagaaaaaggagactcaacaaactgtaaatgcaaatcaatcacaggccggaccaaaagaacaaaaagcaacccaagccaacaaaaagaaagaaaaggtg

SEQ ID NO: 5909 - DNA, 201 bp, Bacillus thuringiensis
attactagccgccggaattgcgtgaaacgaggttttcatctttttccactgaacgatacaacctgggggaatgtccacatgcgtagggcatgtgatgacagagggctacgacatgtcgctaaaactgtagggcgcctttaaggctacgggagtgacgttacaaactaaaaatggacaacatctttttgcgagaacagtgct

SEQ ID NO: 5910 - DNA, 208 bp, Bacillus thuringiensis
ctctgtttttattgtccataagagtgccgtaatggggtgggggggtatgagatagcccttctaattcctctagatccttttctagttcctcattcccatggatttgtgctttaattcctttgttcattcccataagttcgttttcatgagctgtcacttttatattcgacgatccgactgtttgctaaaaatagataaccatctttgc

SEQ ID NO: 5911 - DNA, 259 bp, Bacillus thuringiensis
atgccttttggggtaaacttgccgttgtagagacgaaagatcaagacccaaaggcggggggtgttttagatcttcatgtcggtttactaccgagaacacatcaaattactggtgagaaagctacaatgtgggtacgagagaacggtttagatgacggagatatagaagatgttgcatttgtaacggaaacagagaaagccatcaagtcaatttaaacagaagacgagttaatatggacaaaccctaaacagcgggggtt

SEQ ID NO: 5912 - DNA, 122 bp, Bacillus thuringiensis
atctgagaaaatactgtggtacaaaacacgctggattcgaactaggggcctagcgctaactaatgtacggtactgttatcgctaacatgcgaaacgtatttccatatataagaactccaggc

SEQ ID NO: 5913 - DNA, 149 bp, Bacillus thuringiensis
atgcagatatttaaatggaaacgcacccctagttccaaaaaagcccgactgtctctaatgttttgtttacaagcattttacgtactttcaccatcaccccgcctttctgtcatagaaaaaaactaatcttcccgaaaaatgagaagtta

SEQ ID NO: 5914 - DNA, 397 bp, Bacillus thuringiensis
gggctgggggggttggcccccaatttaaaatcgggttccccacaattctgggggatcccccggaaaaaacctgggggggaaaggttaaaaaaaggcccgggcccttaaaagggcccgggtggggggctttttccaaggggctccccccccgggcggggcttaaaaaatttggcccctaagttaagggggggaaacccccgcggggcttataagaaccccggggtttcccccgggaaggttctttggggcgttttctggtcccaccctggcctttaccggaaccctggcccgcttttctccttggggaagggggggcttttttaaatacctcccgctgggggtttctaagccgggggagggtgttcctcccaaggtggggtgggggccaaaacccccc

SEQ ID NO: 5915 - DNA, 509 bp, Bacillus thuringiensis
cccccactttgtggtaaaaaccgggcggggcctcaaaagcttggcccccaaacacatttttttgaatttttttgggaggaaacccccattttcccagggggggtttttttaccaaaatggggggtcccaaaaccacccggtttttggggttttaaaaaccccccccattttttggggcaaaaaaaaaaaaaatttcctccctttttaaaacccccctaaaaaaatttttcccaaaaccgcccccaatggggaggacccccttttaaaaagggtttaaaaaaggggttttcccaaaccccggtccccccacaggggccaaaaacccccctttttgaaccaaaaggaaaattttgctaaccccttttttttttttcacccctttccccaagggaaaagtggtttttttggggggcccccccaataccatttctccccttacaataaggaggggaaaactattaaacttggaaatccccaaaaccttccccccttgttttggggaaaaaaaa

SEQ ID NO: 5916 - DNA, 244 bp, Bacillus thuringiensis
cctcagtttacttcaggttgtgaaatgaagctagcatggttagttttgttagaacaaccagaagtaaaatgcgaaggaattgaaacattaatgcgttctatatggggaaaagaaagaatgattatgcagaaagtttcatacgaatataataagcaagcgatttcatatcataataaggtagaggttctatttcaaaaagcgatttctgtagactatgtttatgcttttttatgtcttttatttt

SEQ ID NO: 5917 - DNA, 284 bp, Bacillus thuringiensis
ttttcgcatttaaccccttctaaaagggagacaagtgtcccccaacgatcaaaattacattacctactggactgggctttacttattctcttgcgaacaatttgtgtgctcctcctaccagtcttcttgtatgataattctgaatggaacaccactcttactaatgcgcatgttcattcccataccaaatagattgcctctagccaacgcacatggatggtcattcttcagtttcacaacgtttgacaggtcttgtggcggacgttgcaggttccaatctgctc

SEQ ID NO: 5918 - DNA, 129 bp, Bacillus thuringiensis
aaaaagaaccccccgcaaaagcagggaaactaccaaaaactaacacaaaaaaataccaaacgaggggcctaaaaaaacttcaacaaaaacaagaaaaatccagaaacaaaaaaacccgaagaccaaccc

SEQ ID NO: 5919 - DNA, 135 bp, Bacillus thuringiensis
gcgaacattttctcgtccacatgcggggtttcaattaatcggccgaatcgaacgatatcggcacggggagtgttttaaatgacgtccgcttttttctcactaataactgccccttttggccaagcaccggtctga

SEQ ID NO: 5920 - DNA, 211 bp, Bacillus thuringiensis
atgtcatcaatttaaaacgttggtttgactagttttgattagaagacataccttgaacgtcggcaggtcacctttaatatacgttggcgctataacatcgcataaatagggcggatcacaagcccgctctgcctacacgagtacgatatctataagaccttgcgtttaacagtaattataacgaatcggtacacccattaaagtaggtcga

SEQ ID NO: 5921 - DNA, 157 bp, Bacillus thuringiensis
ctggctaggctggtgatgctcgacacaaattcgataaaagaattctcagtttctaatatcatatgtagacccatatggtttgatttaataaaagcgggtgtatcaaaactaaatctttgctctcttacctataaacacaaacaagcttacaagatat

SEQ ID NO: 5922 - DNA, 166 bp, Bacillus thuringiensis
aacttttcactaagattgtagaagaagcgagcaagggggaacacaagggggaaactaaaaaagcagacgccgcgagcaagcccgaagaaaagggagaaacgaagaaagcagaagaagggcaagctgcgcaaaaagagattgaacgactgtcccccagaaacaaaaa

SEQ ID NO: 5923 - DNA, 250 bp, Bacillus thuringiensis
ttcgtgatgaacagcagctactagataggaaggctactgtctttatgttgcagacgccacaaggcgacccgggtgagtgtacacattaagggccgaagccgagacccaccaacatgaaaagcggggtaaagttgtcgcttatagtaggagaatcggttaatggggaggatcgtcaatgggcatagaccgcgggagatatcgtgcataaatggaagccgttaatagtgatgattgactaataaggagcttt

SEQ ID NO: 5924 - DNA, 240 bp, Bacillus thuringiensis
ctcaaaccaatcactccataatcgcttctttaacccatatctaataatccaacccccttcatttcaaacttccctaatatcacctcccctatctttctttccctctaacaccgcttcaaaatttaattctcttacccagacgtctattcataataacacacctactcttcccttctccttacaaaataaccaattattccttctaaactatacaaaaatacccaaattcttcttatccac

SEQ ID NO: 5925 - DNA, 275 bp, Bacillus thuringiensis
ggggggaggggctggcccccaatttaaatttcccgggggttttgttcccggataataaggggggccccccggggggggttcaacccgaaattcccgcggaaaactccgtgcccaaaggcttaaaacacgggggtccccgggaaagggcaaaggaattaagggtccaaatgaaattttaaaaggagggggaaatttaactgcgataaaatttataaaaaagggttggtagggaaaaaaaggggtttttttttcgtttcacaggacattcccaattt

SEQ ID NO: 5926 - DNA, 252 bp, Bacillus thuringiensis
ggggacagcttagattggcgtatccaaaaatcaatgtttcgtttatctctttttttaagaagcttttttgttttttagaaagtgccgaatgttttttccgggggttttttttattaaataattcctgcttttttagttttttcagtttaaacccacttcattttaaaaaattttgtgctaaatttcttcctttttttttttttgcgattcttacccccttttcctttttttccccttataaaaattttattg

SEQ ID NO: 5927 - DNA, 350 bp, Bacillus thuringiensis
acaaacccattgcccaaaccttccctgcaacccagaagggcgggcaaaaattggcccgttttgggatttcaaaccgaaacgcccaacaagagggcaatgaaaaacccccaaaacccccgggccaacgcgcccaggctgaacccacggccgccccccaggaaagggggggaacagacacaaaggccaaaggttcaacttcagggcgagcaacaagttcccataaccccttaggggatccccccggcaacaagggggacgggggcccccaaaaaaagggagggggaggggaaagaacccccccaaaatgggctgggaaaccccaccaaaccggaaaaaaccgggaaccccca

SEQ ID NO: 5928 - DNA, 208 bp, Bacillus thuringiensis
gacaccactgtacttgtttaaggagaggacatccacaccggggaggggttgactgtaaatacggtcgcgtcacctgtatcaaaccaggcgaaagcaactagacgaatgatgggtgaatcagtagcgcgcgctacaatacgtaattgacacatacgggtaccgcggagaactgagactggacacgagacttagaccgtttgatggaaag

SEQ ID NO: 5929 - DNA, 387 bp, Bacillus thuringiensis
  unsure (1)...(387): unsure at all n locations
gttgccctgggctggagaggttggccgccaattcaaaccccggggacctaatttttccccccaaccggggggggttccgaaaatccccccggttttgggtttggatttaaaagccctaactggggggaattggaaaagctggaagagcccctggggcaacctcccttttttatttaatggttggcccccggggaagggggggttttgaaaattaaaacccggattgccgggtatgggggccccatttggcggggggccctgggggaggtctctgggaaaattaatggggggggggccccaaaaaaaggggggggggtggngtattgaaccccggtttattgggtggtgaacccccaccaaccgggttagccggggaaccccaatttc

SEQ ID NO: 5930 - DNA, 466 bp, Bacillus thuringiensis
attttacggaaacctgttcttatgatggcggaccaatggattataggccatagggtgacggtagagggaatacaagagaaccagtcgacatgacacgtatgatcgagccactctaccccactaaggctatttacaagaggtggagcgtttattaaagatagatatctggattagctggcacttgttgaggcggatatataacggggatcgacaggactgcatattaaactacgagattcatcatattgatcaacattcatgtgatggtacgagctctaaagcctgattggcgcaagtggctgatgagtgagcgtgagaaaaagacgagatctcttaagaaagaccaaagcatgtattgcatgaagatttacaatgtaccgctataatgcgagttggacaagctcgtactagaagcagagtatgacagatggtacatgctattatctgacggagaatgcgtatggaa

SEQ ID NO: 5931 - DNA, 303 bp, Bacillus thuringiensis
gacgcatacgctttaggaccagtttacgggttataggtttactcgatacctgaatctaatagaataattgcctctagctgaccaaccttgttagtaattttgattctgatatacagatgagccatcatgtgcttcattaaagtacgataacttatgaaatggcggatatgcatttgaatgttgggttcatgggaatgagcttagacttaaggaaacgctggtttcgtacttgtttcacaatatatgttacgattctgtgcacacgcctaaattggttgctgtgacacttctggtttatatgtg

SEQ ID NO: 5932 - DNA, 344 bp, Bacillus thuringiensis
agacacctcttgttatgcgagctgttacgatgattgcaccctacgggctacgatgggaggtttatcaacctaatgacgtagcggaaatgtctttgttggaacacttcctatgtaacgatgacgccgagtggaacgatactgtcgtggacctttacctggtttaatgtaatagctgatgaagcactggttagagtatgattggccaccggaagcgttgaaccatgctcgttggactggacagcctttatgtggaacatctccacggagaacaacaaacacagaagctacatgggtggttgggtttacacttgatgaccttaactcgtcaaactgatatgctaatg

SEQ ID NO: 5933 - DNA, 317 bp, Bacillus thuringiensis
gcacacggagaatccgccactcctgacggccgtttttcctgacttgggcgagcaccatcgccttggaatatgcccccttaccatcaccgattccatgcatgcattgccaccttttaatgatacctacaactgggcacgcccatagtctttacaggtccttgcccccacttataccccaactgactgtccgtgcagaccataatgcaatagcgcgcccctataacacacgattattccagtggcctaatataggtagcccatctctcactgataatagccgaactaaatgcattgctaaacagacctgtacctttggc

SEQ ID NO: 5934 - DNA, 356 bp, Bacillus thuringiensis
gcatcgggagtatccgccactgtgcaggccggggtttcctgtcctgcgagagctctatcgcgttgggggaagaccgcttatcatcgctcacttcacggatggattgatccgtattaatgatgcctgtgacacgggcgatgggataggctttacagggccttgcgaccacatataccacgatttagtgtccttgcagacggcactcaccttgcgcgccccacaaaagcacggttattcatgtggccggtgatatgatgcaatatactttgctttcacaaaggctctagaagcgggacttaatagagctctgtcattgggcgcagcgtccacatttcactgatcgcctttgggtggta

SEQ ID NO: 5935 - DNA, 302 bp, Bacillus thuringiensis
acacgcgtacgtagcggctcagaacgcgagatgtgaccgtgcacaccccgtttatgcgcccaatttatgccccccccgcgccgactgtcgcgggggggcaactatacgatgcaacacatttatatcccttaactccataaatagttataatgcctcggatagtgccatcaattagcatataccctaacataagcgcactaatttcacgtactgacacctgccccgacgtgccccaaggcaaggcgccacgacttgccgcatgattggggtaaaacatgaaacacgtgcaaaagagtgcctgc

SEQ ID NO: 5936 - DNA, 431 bp, Bacillus thuringiensis
gtattggggcatgccatgtctatagactgattttttgcgcgacgcgctggtaggctgctggtagcgccgatccattcagaacaacgctcttatacggatagtcgcgataattctttctaatgtcctggattgtaccatcacttaccgtgtaccctagcctacgcgctgtaataacgtgtactcacactctccaagtcgttactaatttaggaccagagacaaaactcgcatgatgctgataatgtggatgacgtcgtgcctggagccctactgctactacctcgggacgtgcaatatgaactaatccgaaagaacgagcgactgagcagacatcatagaagagcattggcccaccaagcgttgctaagacatgagaatctaacccgagagggggtagcacactggcaaggggtaatcccggaccgaaactg

SEQ ID NO: 5937 - DNA, 324 bp, Bacillus thuringiensis
gcacggggaggatccgccactcttgagggccgattttccggtcctgcgggagctccatcgcgttggggtatgggcggttatcatagctgatataacggatgcattgatacgttttaatgatacctacatgggggcatgggtataggctttacagggccttgcgaccacttatacctcgatttactgtccgtgcggacgagaatgcactagcgcgcctcttaagaacatgatgattcctgtggcctaatataggaagccaaaccgtttgttatcatagtcgatctagaagcagggctaaacagacctgtaccattgggcgcagcc

SEQ ID NO: 5938 - DNA, 317 bp, Bacillus thuringiensis
gtacacagagaatgggcctctctcgacggcctttttttcatatttaggctagcacctagcccttggaataaggcccgtaaacataaccgattccctgcttgcattaccatctttcaatgctacctacatgggggcacggccatgatctttaaagggcccagccaccccttgtaacccaacagactgtgcatgcggatcataatgaattagcgtctccctatagcacgcgatccttcgatcggcccaatataggatctccttttctctgtgctcatagccgacctcaatgatttgcacaacagacctgtacttgttgg

SEQ ID NO: 5939 - DNA, 314 bp, Bacillus thuringiensis
cgactcagagagtgggcccatcttgactgcctctttttcagatttgggcgagcaactaggccctggactttgcctccttaccgtaaccgattccctgcttgcacagccatctatcaatgctgcttagaaaggggcacgcccataagctttaaaggtcactgcccacacatataccccaaataaatgtgcatgccgatcataatgcattaccgcctgccttcaaaacaagatcttgccactggcctaatatagggtcctcttctctcactgataataaagaaactcaatgcattgcacgaacacacctgtacttt

SEQ ID NO: 5940 - DNA, 259 bp, Bacillus thuringiensis
ctccgcatgctgaacgtgattaggcccccgtgttatggacccccagcgcagcgagccgagggggggcctttagaggagggggcgcttcaatacagcaagctccgagggaacacgccacgacgcttttattcagctatggttgcaaggctgagagaagccttcataccggctgtcacaccgatatggcagggcagactagatagaacgtcacgcggtattgtttacccaaagctcgcggcaccagctggtgcatttgtgc

SEQ ID NO: 5941 - DNA, 398 bp, Bacillus thuringiensis
gcgcactggtatactctaacaaggcagcaatttttttctgcacctaacgctattgcatgaggggccatacttgatggcaatggccgcttaaagcgcgggaccggtgtgactgatgactaacggtccgtacattcgtagcttctgaaaatccaccaacatctctcgctgggtgcttaaaaaccgatgaacgagctgtgagacacctaggcgttctgttaccatatacaccatacgtgttataaaagaccgtggaccgtctgctccatgcccttatacgatgacctcggttttcgggttagcgaactcgaagcttcgaatgtaaaatagtcaaagcatctttgaaatcaaacaagcgcactctgggggacttgcccacgacatcacaattggtctcatcg

SEQ ID NO: 5942 - DNA, 400 bp, Bacillus thuringiensis
gtacactgtgatattcttccaagggaggaatgttattctgaacctcatgtttctgtataaggggccctcccagatggcatttgcacctatacagagcgggaccggtcagactgctgtctaaccgtccttactaacttagctactgtagatgccgaataacctcacgctgatgcttatataatagagaaagaggctgtgagccccctaggcgttctggcaccatatgcaccatgcgtgttatatgagacagtggactgatctgcgttatgccgttatgcggtgagctgggtgtctcggtcagcgtactcgaggtttagcgggagaataggcagagcaactgtgaaatcagacaagagcacttcggggtacttgcacacgatagcacaaatggcgatatcga

SEQ ID NO: 5943 - DNA, 502 bp, Bacillus thuringiensis
gcaccggtagtaaccaatactttgtacgcaagcttttctggtcctgaaagcactgaatcgcgttgggaaaagggccgatctaatagctcatttaacagatgacttcatacattatcctcattccgacatttgtgcatggctatagactttacaggtccatgcaagactacataaccctgtttagtatcaagttgggtcaagtaaaccccttcatttcatctgtagaacatgaagattcaccagctagaaaatatatagcatctccgcttgcttccataatcgaaccttaataaccgcgacaaagaccagtatctttgtgtgcaacaacacctgggcacctatctttttttgctggtacatatcctttacttctatcattagggagcataacaagcagttcaattggggtgaggtcccatacattattaacaaaatcttctaacagtcgggctctatcactatacgcagcagtcactgctaatgctctcattagcaacacccg

SEQ ID NO: 5944 - DNA, 311 bp, Bacillus thuringiensis
atagctggatgactccccgccagcttcggcacagggttttgccccagtgcaccgtctgttgcgatggcggaagtacgctgtggggcgaacacgccgcgaatagagccgagcgcggtagttacgcctgggacagctggctggaatagagtatccggtgcccttcgcacacttatgccgagacctgacccgcttacagacgacagtgatcaagtaagcccctgattagtatggttattcctgttgaccattatacgttgcaatatgagtgcttgtgatacaggcctgataagcgggacttgacagatttgggt

SEQ ID NO: 5945 - DNA, 232 bp, Bacillus thuringiensis
ctaaacaagcttgccaactcatacagacaactggcgatcatttttttgaattaacgcgccgtatggagtatactagcgtcttacatcaagcggtctacgcctctaaacctgagaacgacgcgttatgcagtctatgaacaaccggcgaggtatctacctgtcaaaaaaagacagtcaacggatattccctgcaaacgaactgctggaaaaaagagggcgtgattggaaaaaa

SEQ ID NO: 5946 - DNA, 378 bp, Bacillus thuringiensis
catttattgtattatgaacacaaactaattgaaaggggtaagctggtttcaatgaaaggctctctcacacattttttcaatacgacaatttcgttttgttgtagcaaaaatgttgatacgcccaaacatatgcttaaaaatgatgttcactaaatccccccacccgttgacgcactaccggctccaacaaacatacgttgcgacattaatagcctggaacgtcttgacactgatccaatatcaactgtctatacaccgtctgttcctgtactcaattgctaggaaataagaggccgctccctcattcaaatggggtcaaccctttcatagaaagggagttatggcacacgaacactgaaactacatagggtagcaata

SEQ ID NO: 5947 - DNA, 106 bp, Bacillus thuringiensis
acatatgagtagcggtttttttttttctgaatctacttggcacacacgtttgagtgcattttgcaccatttatagaagatgcgtgctaagacacatgacaatgatg

SEQ ID NO: 5948 - DNA, 228 bp, Bacillus thuringiensis
cttccttctcccttaaaagatgatctagatccatcgttatgcccttggataacacccagctagaaagttataccgagagctcttatacatcatcttacgaacccgaacttgcaccaccaactatatatcaaataattcctacaccacgccttcctgaagaaacaatcgagattacaaccgaatgaacaacataaactcgatctttttggatataaccaatatcaaatt

SEQ ID NO: 5949 - DNA, 394 bp, Bacillus thuringiensis
tacaattgacatgcacgatcccagttactttataacagttacaacagctgcggcatgtaccgaggaaccggtgcgtttcaaatcttcctgcatatcatgaacaccaccccaatatgttacgccaagcatttcttctctaccccatcagcaaatccattcaccaatatgattggataattattttgttgcctctcttcagcgcatgatattttcgctgcgaatgaacatacgggcactaatgcgaaaaaacatatttttaaaaataacttccccatactttctccccctaataaaacgtttacatttttctttgttaaaagaattaacagaatactttaacaacttatacataatgtaaagtattctatatacgttgtatatatagaaaacatat

SEQ ID NO: 5950 - DNA, 439 bp, Bacillus thuringiensis
ttcgtgatgatgtagatgtacccagtcgtgtttacacacgctttttctcccctgggccagcactcagaagtgggggctgttacgcttggttaaatgcactcacctcagctacctctccgtcttttacataccgcttacatatacgcggagacgagggttgagaacactgacctaccatatccgaagtgagagttgccaaacatacagccctccaataatccagctctaacaacaagacatttcctataagagacagcacagttactacatcttcagcgaccatagttcttttaggatcccagctatcaggtagcgcaccaccggggaacgagaaaataaaacaaggtgcatattccagaactgataacctccaatcacaaacaggaccattattcggtggctccactataaaatacagaggtgtcatcttcctgaccct

SEQ ID NO: 5951 - DNA, 108 bp, Bacillus thuringiensis
aagcttgctaacgacatatagtttgagaaggctagtttttttaccactccattgccttattacaggaggcgggtaagataaagcactgactatttcggacgtccattt

SEQ ID NO: 5952 - DNA, 133 bp, Bacillus thuringiensis
aattttatgttttgtgtttaatctattatattaactttcgttcttgcattgcagctgatatgcatgtacaaactttctcacctctttatttaaatcatccgcttgatctaaagccgaaccatgaccactattt

SEQ ID NO: 5953 - DNA, 128 bp, Bacillus thuringiensis
ctacacatgtaaatcaacactctggtcggaagctatgttgcaccaaaagacacaacaaggtaggggagccatgatcgaaatagactggtatttcccactataggcaggactacttccacaaactgaaa

SEQ ID NO: 5954 - DNA, 106 bp, Bacillus thuringiensis
taaatccaagggggggttgtaaaactgatagggtgtttcaccacgctggaacaccagtgcacaaatgaaatgcgaaagctccaacagaaaagaacgagattcccag

SEQ ID NO: 5955 - DNA, 101 bp, Bacillus thuringiensis
aggctcgttaagcttcccgctccaatcacccaccgtttcatcttcgcacccagactcaccaatggggggggtttacattaaaaagttgttttaaccccccc

SEQ ID NO: 5956 - DNA, 341 bp, Bacillus thuringiensis
cctagattctatgcgagaaatgggatttcatttcgtataggacgagagaagataccgagggtaggtggaattttcatgtcaatgaccttccttaatacactctctacataaccctgcaacctatttttatgaacgcgctcaggtgagtgcaaattgtacgacactcagtgacggataccaactatgactgcaagcaaagatcacttacatcttacgcttacgggaaatccttactactgcagaacgccatggttatgggaccgaaaatatatgtatcttgcactgcgagcaagaatgtacaaggttctaatatcgggacgatgtggaaggaaaggtatatt

SEQ ID NO: 5957 - DNA, 279 bp, Bacillus thuringiensis
ttttgaatatcatgggcggaattcaaccgcaactggatactgtaggatataaacaatgaaaacaccactattgaatttactggcagtcgtacattatttcaacatacgatccatatggaaattcgctcttataattcaatgaatgggccgcttccctttaaatgacataaagagaatgtcagggcatagagaatttcactctgttttcataccctccgtatggtctgtttaaacaatgatttacaaatagatagattttctttattgaacatacagaga

SEQ ID NO: 5958 - DNA, 230 bp, Bacillus thuringiensis
agcctgccaactcatatagatacgctttattttcactggggtgcgaaaacgttagggcgggtgacataataattgccgaaagaacagagcgcctgtactggttccgccccttcttatacagcttaagctcgtgacatatccaatgtgcgtacgatgagcattctaccggggacagaattatatcctccatgattccctttcatttgcacgccgagcaatccacaggaact

SEQ ID NO: 5959 - DNA, 137 bp, Bacillus thuringiensis
cacgaactccggacccgcaaggtggcgcgctcgcagcagggctaggaaccgagctacccctaaagtgacgcaccagacagggcttggcataaccatggtcatagctgggacctgggagaaattgcggagcgcggacc

SEQ ID NO: 5960 - DNA, 223 bp, Bacillus thuringiensis
acaaacatgcaattaataatgaccgagcgcatctttttcggagcaactggtacaactgaagggcatacaaaaaaagttaataccatactaaagatacaatccaatacaaacaccttatcaattcgtgataagaacctacatacgacagtcctttagtaaaaacccatctaaatggtctttaaacaacgaaacggcacgttcaaattcctttcacttcatatct

SEQ ID NO: 5961 - DNA, 271 bp, Bacillus thuringiensis
ttccaaatcatatccaattacatttttttcttatcagcagtgtcatacacaaaaaggcggggttgttactaatgtatcgcacatgcaacgcataggaaaaagtcattcccacttactttttcgtactcaacacgtacccatacttcacgatcaaaccctactttccaattcaacttctaaaaccaacctctgttaaaatgagcttctttaacccaccagaatcctctttgaagcttcctcattagaagcgagcatccccataaagattgca

SEQ ID NO: 5962 - DNA, 415 bp, Bacillus thuringiensis
agaacacgcttgtcttactgcttggtcccatgaatagactgcgatgggctaaaaagtgagctcaggaacctcatgccgtgctgggaaagactctatttgagccgaaccatagcatccaataccacttgcataactaactgaggctggatctgtacctggctccaccagttggaaaacgagtacttgccgagggggaatgctcacggaaaaagtgaaacctgtacgaagctcggtcactgtactaatgatagacaatccggctggattaacaactacatcagttgttgagaggaggacggaatgactacatgacgtccactgaacacactgaatgatatgaacgacagacgcagccaatacctggaatgtgtgtacgtggacatactgtcccagtcgtaccaggatcatggactgg

SEQ ID NO: 5963 - DNA, 358 bp, Bacillus thuringiensis
gcctaccctgggcaggaaaggctgccaaccaattaaaaaaaaagggcccttttttttggggtttcccaaggggcccccccggcggggggggcttaaaaaaatcggccgctaaggccagggggggaaacccccgcggggcttataaagaaccgggggctcccccctgaaagttatcctggtggccctttcttgttccgcccctgccgttaccggaaccccggcccgcttttcacatgtggcgaggggggggcctttttaaacccccgcgctgggggcatcagaaggggtgggaggcccccccccccaaccgggccggggtccacaaccccccatgtaaccccgcccggggcccttaacc

SEQ ID NO: 5964 - DNA, 361 bp, Bacillus thuringiensis
gcataagcggaacaccatcgtgcttattgtgacctttaagccagaaactaaccttaaacttatcaatgttcactggggttacaactgaaggataaagataacaagagcttcatcacttgcgatgagctttttcttctatgtataaaacacctttttatggtttgatgttaaaacttcactttttttttgagttttatatctcattattataattccaatatttactgtgtaactaatattactaatttttatatatgtgaaaaatgattaatttaaaaatttatacaaaaatatgaatttatttatatgaaagttctaatttacgtatcttgcgggggaaccaatattaaaatgaacgaaa

SEQ ID NO: 5965 - DNA, 443 bp, Bacillus thuringiensis
gctaagcaagcctgccaactcatacaactcgactttattggtaccaaacgttacccccagcaagctgggttattcaaacatctagagggtcccacaccatcaccgtaaacctacccgcctatcccccacttaaaaagcgtagcactgtctcatagaccactctgcaaggaacgcagatcactgtacaccgagcgattcaagctggaccatgaacacgaacccctgcatcagcctctcccggagcgcctaatacagtacactaaaaccttcaaaccaacctcaaaacacactagttcactacacagacattaaccactaaacccatctttactactatccgcaaattaatacagctctccaaattacatgagttcatgatataactactaactctcgaaagtaacagcgtctggtaaatgcgcatctcacaaagccaaaacctt

SEQ ID NO: 5966 - DNA, 176 bp, Bacillus thuringiensis
tgccgattatagcgctttaatttgtgcctgtatgacgggtgaacaattttttggatgtaaaaacaggaccgtgattttttcacggtctgccggtcatttgctacaattatcgtaagatgttatagtagggtttgttaccagtgtagacagcgatcctgggttggtagtatccgatg

SEQ ID NO: 5967 - DNA, 391 bp, Bacillus thuringiensis
ctctgtatagacagaaccagtctactctcctacgtttttatcttgttgttggataacatacacgcgagtctgcttgtcagacataacctctacagccactgcagcaccacttgatcgaactacctttataatctccggatcaggtggcaaagaaggacagtccgcgcgcatgtaacccaaacacattcgcgactatttcctgaagcccaatcattccaccaatacttacgacacctttagcttgtaagaacagcaccttctgctgatcagacgaatgtactatctcacgaagagcccgaacatgctgcttactaatatagcggcgcccatgtcatgcagatgagatcatcatgcgcaattggtgcgctacactcaaagttacataaaaccc

SEQ ID NO: 5968 - DNA, 194 bp, Bacillus thuringiensis
gggggtccataccaatccaaacgtcttttactataactgttttaaacataagcaggacgaggggggatagatggggagagttttagatcaccacaccgaatcaaccccagctatagtggtgaaaaagatctcaatacgcggctttactgaaattcctaactaaagttggtaatcgaatgccacacaaatggtac

SEQ ID NO: 5969 - DNA, 252 bp, Bacillus thuringiensis
ctgcactgggatcaccaagctcggcacccctttttttaccccccattggatgaagactcgtggggaattcttcgtcaaaagtaactcttaaatagcgtgtctggagggagagcatagttccgtctggaaactctccactgccaatgtggagagaggctttctgtaggcttctatcaccaagactgcccacccgttgtgctccaagcattgctctgaccctatacacaatacttgttgtcctaggccacgcac

SEQ ID NO: 5970 - DNA, 255 bp, Bacillus thuringiensis
ctacacagtgatcatcaaactcggctccactttttttaccccccatgggatgtccgctcataggcaattctagctcaagacgggccagtaaacctcgtgtctggtacgaaaccagagtcacggccagaacctcctcactgcctagcagtaggcaaccttacctgcaggtttctatcctcatgacttacgagccgtcatgctccataccgttctcttaacctatacaccatactttttatacgagacagcacactg

SEQ ID NO: 5971 - DNA, 344 bp, Bacillus thuringiensis
ctactcattgatcatcagactctactctgaagcttcttcgcctcaagggatgacagtatattcggggttcaagctcgaaacaggcgtgtattctctttctaaggcccgaaaacatagaaatggctaaaatgtacaaccagcctaactaatggcaacgatagccatggcaactatgctcacgacatacgcaccttcaccaaccagagctacctcttcacctattcacgaaaccttagatacgagaccagttaggatctgcgtagcgacaggaatctgatctatctcagcttggtctgctaccgcttgaagctgaaggacaagcggggcataaactctcaagccac

SEQ ID NO: 5972 - DNA, 516 bp, Bacillus thuringiensis
ctgcactgtgataatctaacaaggcaccaatttttttctgcacctaaggcttttgtattatgggccatacttgattacgatggactcttaaatcgcgtgactggtgtgagtgctgactcacggtcagtaactcctaactgctgagtagggaggagcatctccgtctggttgctaacatcctgatttacgagcagtgaagccccgaggcgttctgttcccaaatacaccatgcttgttatacgagccagtgcactgacctgcgggcatgtccttatgctatactctgtgttttagagtctgcgtactctgcgcctgcgtggagtatagggaaagcaaccctgtaatcagacaagagcacttcgtgcgagacacacacgatatcacaaatggtcttatcgatataggccgattcgaagacgctccagcactacgtgcagctctcggcctcagtctgcgtgttcttttctctctcctccgtcagcgagcatctgctgtacacacttaaggagcatcata

SEQ ID NO: 5973 - DNA, 304 bp, Bacillus thuringiensis
ctcctcatagatcttcagactctactctgctgctttttcacctacctggatgacagcacacacgcgagtctagctcaaaacaagcacgtatactgtctataaagacggaaacaatagtactggctgcaaagtcgacccagcctgactaaagagtggcataccgcacgcaagtatcctcaaaacatacgcaccgttatcctcaagagcatcctctgcacctatacatgaaacttttgttacgagaccacacactacgttcagcagcgacgagtaactgaactttctcaggaacgaccgatacagc

SEQ ID NO: 5974 - DNA, 260 bp, Bacillus thuringiensis
agctgtttttttctgcttgatatggagcttcgtgcggtaggactacgccacctgggcttagaacagacacttggatagggattaagtcagatcgttatggggaatttatgagaataagctttcgcccagagctttattgcacaagggcttaagcatatcagggcgcggcagatatccgtttcggctttggctcatcctttgggatgattgccaccttacttgatgttaacgggattgtacaaaggttggggagccccccc

SEQ ID NO: 5975 - DNA, 486 bp, Bacillus thuringiensis
cccccatccgtttggaaaacaggccccggggcctcaaaacgcttgcccccaatccaaaataaggttttttttggaatcccgtttggccttccggggaggttttgtttcccaaccttttattttttaaaacccccggggagtttcaacccgtcctttttaataaaataaataaaccgttcccctatttcattaaaaaaagcctggccctgaaaaaaatcattttgggcctgttaaacccctttctgaaaaacccccataaatttggggaaaagcccccggtggcccttcttttaaacccctttcttttttggcagctttaattttttaagaacctggtggaaaaccctttttttttgaaccagacccaggccccctttgaattattccaggatttggaaagggtttccccggggaaattttttctttctaaaaaggagggatatcggaattagggcaattttttttttttaaagaccggaagggttt

SEQ ID NO: 5976 - DNA, 356 bp, Bacillus thuringiensis
tcccccacatacaaagacgcttcatttaagccaggagtgacttctgggactgaaaacctatttactactggctcaattctgagcgtaaagcggaccgaggcaggacaagtatttggtcctttgtgagcttaccaacacagcgcacgatcagctggtttttgcataagaggcacattcgtaacgaagcgaggaatgtgaaacacctcaccattgtgaaatcaagtgctattatcgttccatacaccaaacagactctaggggcacacaaaacaagcacgagttttggtaaaaaataaacacgttttgctgaaaaaaataaagggggggttgagccccaacattttaggctttttaca

SEQ ID NO: 5977 - DNA, 406 bp, Bacillus thuringiensis
atgtggagtgaggcaaaccacactatgcgcccctggtacggcccccaaatggaaaaagcccacggggggcttattgaggagagggggccaatcaacaccgcaaccaggaggtaaaccgaagcgcggtacaagacgcaggcgggagtagcacgcaggaagaccagcgctcgcaccgtaaacgacaagaagggcacagccaaaaggaaaaaacagagctgaacataacaccagaaacttgaggaacgacagaaaacatgtgtgggggcatatcaggagcctacacaaaaacaaacagactcagaacctctggaatcacgaagattaagtcgcaccaggcagctgaaaaaaacccaaaaacgaaggcagatgccccacctccacgataccaccaaaaggacgggagccc

SEQ ID NO: 5978 - DNA, 399 bp, Bacillus thuringiensis
ctactcattgaccaacacgctctcgtccccttttttgtgtactagttggttgtaaatacacgggcgattcttcgtcaataatagcagctctatcgtctgtatagatggaaacaatcgccctatcagcaaacgctacagtgcctgttttaacaggatcagactgcacgcatgtatctgcaatacgtaccaccatttgtgctagctccatttcttttactttatacataatacttcttttcggtggccacacattacctaacgcagagatgaggcctgtcctatctcactcacagtctgtacggcacgcagctgtatgcgcaactggactatccatcagatgacagaataatgctgtagctgccaaccacactccaagccacacaactaccccagcttaaa

SEQ ID NO: 5979 - DNA, 261 bp, Bacillus thuringiensis
ttttcttttcatggaggaccgctaggccaattaggtggggcagagacatctccatgtggaaaatacctcatctagacttattatgatactgcaggatcattaagagcaccatctcgactgggtgaacaagataagcctgcctcagctaaagcgacgaatcgatgatgatactatatagacaccgcaccatctattggctggacaaatatcaatattgttggaaacggtgatgcaaacccaacatggctctcatgatgaaac

SEQ ID NO: 5980 - DNA, 200 bp, Bacillus thuringiensis
aacacctagagttttattcccccacggcaatgaagaaacgaggggggggtaaggacaaacgggcatgagggcccaccacaacaccaacaggctcggaacggtaaaaacaccaaaaaggggaccccagacaaagaaaaccgaaaaggaaaagagaaaatacacaagcagggagacagaagcacgcccgatgggaagaacaa

SEQ ID NO: 5981 - DNA, 111 bp, Bacillus thuringiensis
  unsure (1)...(111): unsure at all n locations
gcttggtgtaccttcaggctgttttttatattaccatggactggatggctcgggancggcagatattttattccttgccgccctaccccctgaaagatcaagattaaggtg

SEQ ID NO: 5982 - DNA, 405 bp, Bacillus thuringiensis
gtggtgatgcactacattaaggactatttgaagaggatttttagaaacgctggatgcggtaaacaatgggggtgtatttcacttagatgatgtagatgcacagttacatgtacgccggttggtagagtggattgaatttgtgggccaagcccagtatggatttgaacaggtagaaaggcgtctcgttctaaaggattttttacaacgtgttaaatgacacagaattgaagtggattcaatctggggtccgagagggtccccatcaaagcgattcaggggaacggggaggtatatgacaaacgcccgtaaatcgcaggggacgacacgcgagtctgttcactggtggcgggggcagctttagatacattgggaattatattcatcatgccaaaaacatgtgaaatg

SEQ ID NO: 5983 - DNA, 294 bp, Bacillus thuringiensis
  unsure (1)...(294): unsure at all n locations
aaacacatgttcccagagagctgggtgaaacaaaaggcggaaccacnaaaagtaaggaagaaacaacaccaagctatagcaggaacttaattgactggaggcgagaaatcgttactacttattactgaagcgatacgggcctcgaattggggcacgaaattatatgaaaaagaggttctagcaactgtctaaagccactttttatacacttgaattaaattacaccatacaataagtcctaaagatgtaaaaacaccacccaagacaattaagataagtgtgtctaccatatta

SEQ ID NO: 5984 - DNA, 282 bp, Bacillus thuringiensis
ggatcaaatgtgcttgtgttgtttgagcccgacgtataacacccatcaacaaatgcccccgggctgtttgattccattatccccactctcttaaaaaactcggaagattatgtacataaggatccttcttttttcaaataatacaagcaccatcatttggaaagaaggtccctgcacgaagaaagttaagtggactctatatgggcgcatcccaacgttcgaagacgcgatgggactctataaacttatggagtcagctttgtggctatatgacggacgaaa

SEQ ID NO: 5985 - DNA, 478 bp, Bacillus thuringiensis
tcaaggttacgtatttgtgttttaaaattattaccatgcttatcttggggggcggctaagataaatcccaagcaatatactaattttcagattccaccatcaatgagatctagataaacaaaaagaacatgcatcaatacttacgccagactcaaacgaaagtgcttatcatatgctttcgtttttttgccagcagaaaatctgaatgctacatactacagacatcaacattacttttcacgtttttgaacatgacaatttcagatggaacaagtgtcaagagtcttagaatggcaataagtttcagtttcattaataaccaaaagcatctacggagaacatattaccttataggttcttccagcttgaacgattatctccttgaactcctcattgtccctaagaagtataaacacttagagctagaaatcgtgaattgaagtgagaatctttgtgaatgaatggaagctaaccttga

SEQ ID NO: 5986 - DNA, 172 bp, Bacillus thuringiensis
aacaaatggggtcataaatgaaataactccatattgcactcataaaagacttatcgccagataacacatgtctcgtatactatggctaacatgctgccacccaatcattgcatgttttaccataatccaattataggatttacggttgttatacaggcaatgcatatggccc

SEQ ID NO: 5987 - DNA, 150 bp, Bacillus thuringiensis
  unsure (1)...(150): unsure at all n locations
atagggcacgaaatctggancaaaactctgatatttctgtcgacaaaggctttctctgaggacctaggggctagcnntctagaaccacatnncgtgtgggtggctcancgagnnntcgcggccccgctgttnattctattagtggtcacc

SEQ ID NO: 5988 - DNA, 407 bp, Bacillus thuringiensis
tgggctggaaaggttggtcaccaattcatttttcgggggggttgtttttttatggccgggagaaaacccagggaggggaatcccgtggggggatattttggcgggaaattttaaaaccgtcccctcccgggggcagggggttggattccaaaacccatttttcacatggggcccgggggcccaaacctcccgggtggaaaccggggctcccttaatttataatttttggccgggcccaaattcccccctggtttaaagaagcccaacgcccaaccgggtttggccacaaaaaaatttggggaaaatgggggcaacaaaaacttgaaaaaaaaacctttccccaccaatgggggacccatttttttacccattcccttaaaataccccggaaagggcccttccacaaa

SEQ ID NO: 5989 - DNA, 344 bp, Bacillus thuringiensis
gccaccaatccacatcaacacaccttatctttttctacaaaccaactaacttcaaagggacagggtcacttttaatcaattgacacccataacacatcatcttaccctaaaaaaacctaccctcccactacctctaacccattcatctcataataatacttataaactaccattcattacgccaccttatccccttataatcttcacaacctctcaaaacataacctcttaaaaaattcccatacctctcccccatacatatttcaatttcttacatacttctaacctcgtcatcagctaaaaatatatattctccataccgttaaataacatacaaactacca

SEQ ID NO: 5990 - DNA, 166 bp, Bacillus thuringiensis
tgtagcggtttacaccacccttatccaccactcctacatgggctaaaagtagaagcactcgctttttctagagttgtattaacccaaaaatatcatctccgcccccaaatagcgctttaaaaggatcaacccagttatacccccaaattaattagacaactcaccc

SEQ ID NO: 5991 - DNA, 150 bp, Bacillus thuringiensis
actgcatccttagaatcaggttgatgctcttaaaatgaatcgtccctttctcgaatgcgaaaccgggttatttggtccatgacgattattcaaaaagggtatcttcacccttagactcctctttaaaatttaaataatgaaagtctttta

SEQ ID NO: 5992 - DNA, 121 bp, Bacillus thuringiensis
atataagacaaatttatactaccccctcagagcaagcccaaatgggggggctatttaaaaacactgaggcgttgattaaccatggccacaagtgaattaataacggaacacggacactgag

SEQ ID NO: 5993 - DNA, 108 bp, Bacillus thuringiensis
attcggcaacgcacccttggccaccaccaactctgtgactggacaggtgaggttttttaagacccacggggcagctacacaaacggcacgggaagataaagccaaccc

SEQ ID NO: 5994 - DNA, 119 bp, Bacillus thuringiensis
tttcacgatccagtttatttgctaaccatacaactcttacaacctggggacactttaagaatctacgcgtgttacaaaatcactacttctaccacccactcttaacgcctgaccatcaa

SEQ ID NO: 5995 - DNA, 331 bp, Bacillus thuringiensis
cttggcaaaacattctatcccccagccatctactaaccagtccatggggcgtttttaaaacagaagggcgcttgtaacaggcaccccaaacgactatacgttctccaagggaaccacctaatgcaacccgcggaacatatgccctacttacttcatctaccacaactaaagcaaatgtaccctcataaataaccgaacccatggcacactcacataaaattgcgccccttactttcgcattttcaataaatccctattctacccctacacaacccaacctctagctttcccaacatcactcccaatctcttggataccccttttcaacagc

SEQ ID NO: 5996 - DNA, 119 bp, Bacillus thuringiensis
ccgaattcggatgcttgctagaccttaggctgtttaacttttaccatggactggatggctcggcacagcagaaatttatttcttgcagctctagtggctgaaagtccaagattaaggtg

SEQ ID NO: 5997 - DNA, 108 bp, Bacillus thuringiensis
ttaaaagacaaatttttttacatcctcagagtcagaccaaatgggggggctattttaaaacactgacgcgtggctcagccatgccaacaagagaattaataacggcac

SEQ ID NO: 5998 - DNA, 251 bp, Bacillus thuringiensis
aaaagagacacgcccataaggtgttgggttgtataacaacggttcctaccccaccacgcacacgaacgctgaactacaactatcgactgtggatgatctcggaaacaacacccaagagatgctcgaagttcaactgcaaatatatgatcaatgcggcggaaaataaccactccaacagcgcggtattgaaacttgggctatcgaatgataaagcccactcgcgctggcataccaattatacgggtaaaaac

SEQ ID NO: 5999 - DNA, 305 bp, Bacillus thuringiensis
ctgcgcgtattgcaactattcatgtatatttttccattaaaacgatattggaggggcaggtggctttttataaatcgcttgatataatcacatacgggaaaagggactaccgtcgcctttccttgggtcaacatgtgcatcgaagactgttgcttgatgcattccgtacgctaaaaaaggtatgctataatactctgaggatacctacaaaccattatcagctcggctggcttctccctaacgtggatcatcctcaaccttgtagtactagacgctctttacttgttggcagcacgagcgtattg

SEQ ID NO: 6000 - DNA, 297 bp, Bacillus thuringiensis
atttatagaacccattgatcattgccccgatcataacgttatgggactggagactcatctgccaggtcacattggtgttagcgacgccagaagagtcagcgttaacaggtgaaacaccccacgacggggagtctcccggtgccacattttgaatatgatcaatcctctctggtggctgctcagatgagtaaggaaatgaacgatggacgaccaactttagggaaaacaattggaccggcgacaaggaaaatatgcaggcaggcgcatattaatccttacgtcgaggcacttaacaag

SEQ ID NO: 6001 - DNA, 208 bp, Bacillus thuringiensis
ttataagacaaactctactacacccccaaagtcagaccacattcgtgtgctctttataaaacactggggcgttgctaacccacgcacaccagagaatatataacggaacatgaacactgagcagaattaccagaaggccggaacacacgacagcaaacacccgcccatcaaggtcaagagccaccactaaccgaccaaaccaaggcgc

SEQ ID NO: 6002 - DNA, 249 bp, Bacillus thuringiensis
gcttgatacaaattccattgttcagttgaggggctgatggttgcaaggagaagggcggctaggatatttcccttgactactcaaaaaaggttcacgactgtacacatgaacagggggcactactgtttagaacatgtgagggctatctaagatcacaactagaaatataccccacaaatagatattacatatgagcgtgaagaaaaataaaatacgtggaaaataccatcatattacactggtgtatga

SEQ ID NO: 6003 - DNA, 536 bp, Bacillus thuringiensis
catggatatgacgtcacattcaagtttatgtcgcaacacaaaatttggtagaagggtcagtttatttttcagcacacatccaaggtccaaagcccacaagaatggcaacactctattaatcccacaaattcaagctgtcctcgtttttgtttgtttagcaatcgatccaattcacatcgaattcaaccgggtcaagaacaagcgactattttgattcacagattccaaatgattttgctcataattagccagtttcagacaaatgccaaatctggaaaacaaaaaacaaaggcaaaaacgattaaatgaaaatgaagtggtttagcggataattttagaggctaaactatgatgaacaagtatgcctccacgttaacaccgcagttcaatatatgcctcgaagactagcttcgttttcgtggttttatatcgaaaacaagctaaaggtgatgtgaggcaatctaaaaacacatcctttctcccccaaacagtaaaaccatgtacacaggtgacaaataactatagatatcgaacaa

SEQ ID NO: 6004 - DNA, 142 bp, Bacillus thuringiensis
aacgtgcggaatccacaaattttctgttggaaagctgctctgtaaaaaggaggggggctctttgttaactgtgtacacacatcacaaacttgtttgtgcgaagccttctgacgcgtattcatgggcagatattcaccttgac

SEQ ID NO: 6005 - DNA, 150 bp, Bacillus thuringiensis
ttgtttgtgaatttgaagcttcaatgtactcggaacctttcatcgttcttatcattgtccatcctttctttaataatagccaagatgctccgaatactcaatataattaatcctttattaccacaggttgcacaagacttaattagattt

SEQ ID NO: 6006 - DNA, 232 bp, Bacillus thuringiensis
  unsure (1)...(232): unsure at all n locations
tatagttgtgtttttaacccctacgcccggcttctggatgccccattactttttgcgtttttttgttcttattgtaaataattaattgaaaaaggaaaaagaaaaaagagaannaaaaataaaaaaaaaacccccccccccccccccccccttttattttttttattttaaaaattttgttttgttttctcaacccctccttttattttttgttttataattaacgtttttt

SEQ ID NO: 6007 - DNA, 235 bp, Bacillus thuringiensis
tggaaaagctttttttctaaggtttactggaccacacccgtggggctattggtggggggaggccgaatgacttggaattaaactgggcgcatattcaggtgctgcaaaagttccctgcgtggacatggagaagacaccagccctctgtgcactgaataatactgacatggaaaaaggcgataattgcgcctacattcgcaaaggctatcaagcatattggaccccgtccattact

SEQ ID NO: 6008 - DNA, 417 bp, Bacillus thuringiensis
gcaccagatccctttgtgtcccatgaatcacaatagctcctagggctacagccgctccagatatcccttgcacacctggcactccctgatttccatgaggaccttgtgggcccagagctgctaccggacctcgaatgcccagcatcccctgaggaccctgtggacccgtggctaacactgtgcctggaacacctggacccccttgcgggccccgaagtccctatgggcctggtggaccggtagcccctagctgaccaagtagccacgggacaccaggagaaccttgtgacccatgcggacctatgtgaccttgcggaccttgtattgcctgagcaccatgtgctgctgtacaaagtgatggtgcaaggattccttgagaaccatgcggacctcggactccctgacagccagatggac

SEQ ID NO: 6009 - DNA, 474 bp, Bacillus thuringiensis
ctacgagcggaaccatgtaatataatcctccatgctttctgttgatcccgccgtgtgacataaatagtttcagtataacctaagcagttcgtgtttgaggcacatacttatgtcacaatagaagtgtattaaggggtgatcgccctaggaacagattatgtgatgttatgttaccagtagacgtaacatttatttgccaactatcacaaaaggcctggagacacagttaataaaagtcaatcgcttcattaaaaacagtgcccattgaaacatacattggactttgaccttgaattgaagcaacatcaacgtctctatccttcacatgcacataaatagatgcgactacagatgtatatgcttcatcaaacgtctgaccaaagggctcacactacaaaatgggagacacattaactagaggtgcaggaatacacataacttcatgcgataaatcatttgcacaccatatttttg

SEQ ID NO: 6010 - DNA, 236 bp, Bacillus thuringiensis
gatggacataatttttttttatcctccacctggaattatcagttggggcgacattgaactagacgctcaccatactcctatgaagaaggccgtttacgaatgaaagagcgccctctcgagtgggatgggctcactacaatgagagggtgaatggtatgtgctgttgaaggtgaggctttctcaccatggatggggattcctccctttgctatgccatcttatgccgcaccataact

SEQ ID NO: 6011 - DNA, 276 bp, Bacillus thuringiensis
cgtcccctatatttggaatagtttaatgtgaataattttttaccacgccgcattctgcggacatatgggaggtgtgtatgcatgctctgggtctccccctgcattccgcgcatatgcgaaatctgtagaggctgctacttgtcattacacagagggaatgacaattgactggtgcctcaaaagtggccatcaaccagttggcggactttaagccggtcctatcattaactgtgaccgctgtgctatgagacagcttatgatggaaaaggttcttgt

SEQ ID NO: 6012 - DNA, 226 bp, Bacillus thuringiensis
cccccggggcgagaagctcctcgtcgacatcatattttggacaaaaatttttcttaccagacaccagtccctatcaaggagtgatattataaggaaagggggcgctccacaaaccaaaacaaagaccatctcaacctaaagcacccccttaccatggcggacgaggtaaaacctatgagccccaaaagggccagcccactaaaaaaaaacctaaaaaaaaaacacc

SEQ ID NO: 6013 - DNA, 249 bp, Bacillus thuringiensis
acggttatccacatactcaggatctaactgcgcattctctacgtgataaaaccgccttaacaagggggggaacagtgacacggccaagccggttgttcattaccatctcactgcgcgaacacgcttcttgtgcctcgcttagcgctagaccacgaatcgatggggcccgtatcgagcacgtccctggattctatacgagtgccaaaactggcaaaaaaaacactgggcggtggtacacaacctgcgcac

SEQ ID NO: 6014 - DNA, 125 bp, Bacillus thuringiensis
cccgggctcgccttgcttgtcaccaattcatatagttccgacttctactcaatcactcggcgttatgcttgcggggggattttttaggccacgcctcgttgcattaagccagcttattttcttac

SEQ ID NO: 6015 - DNA, 238 bp, Bacillus thuringiensis
ctgtgtagacactgaacgaacccactcagactcacctcttattggccacacaataaagcaagcgcggggggacccgtgtatgctaagacacaataaggtcttacgttggacaaccaggtaaaactggctgaggatgtactattcgacgcccttggagtcaaccagccactgatctgtgagcgacagctggtgcaggagctacaacgcttatcaaatcctcctgcattgaggcggttta

SEQ ID NO: 6016 - DNA, 374 bp, Bacillus thuringiensis
agccttgatccttagtgcagcctcggtccatagtataagactccggtccttatagaatagtctttattcacagctgacggtgactccgtaccgacgcctttccctttgtagacgggtaagttacttcgtcactttaacgtacttttttgcttactctatcataggccttcgtcgggctggctttcatcccaaagcctataggctctggcttggcttcgatatcgctcatgacttgttatagagtccgtgtagtggtcggccttcccatcagaaatgggaaatgatagagtggtcggccttttgcttgcctccttccagctcagaatgcctaatgcctattataagttctagaagctaaccgccagaagctcacc

SEQ ID NO: 6017 - DNA, 483 bp, Bacillus thuringiensis
  unsure (1)...(483): unsure at all n locations
caaagaagaagaagcaatgttcatcttcgtaccatcagtagttagtgcactaagagtaccattgtttgtaggattctcaggctcattcaaagcaacgttaatctccttagcattactggctggcgcatcatgaagatctggaaattctgcacagaatcaagactgtagagcatgagttttgaatgaattaaccatcttgaccatttagcattaaagtgaaattggaatccatttcatgcagttaaagtaaggttggctttcttatttcatagctgtttcctacctatctcaggaaaatacgtccctctgattggaccacangttataacatagaaagagagtttttcctttaacanacaaaccaacggattattcatgtagtgtagtattcaaagaaaactaaccatcttcattcactttaatcccctttgatggggtatcaggggtcatcaccaccttggaagaaggttgagaatggatctc

SEQ ID NO: 6018 - DNA, 460 bp, Bacillus thuringiensis
cccccgggcctgaaaactttggccgccaattaaaaattttgggttctttttttgaaaatccggccccataggccgtgggggggggtcttaaacccggccttggttaaaggggggggggaaaaaaaaaatttcccccccatttaaccctttttttaaagattttaccataaaaaagggtttttttttattcggcccgtttggaaagggcaattttttaaaaaggggtcaatcccgttttggatcccggtttgatccaccaatcctttaaggttttgaaggtcttaaaaaggggcgttttgatttcaaatttaaaaattgtcaaaaaatttggcccaagggtacaatttccccgggggggtttagggtcttaacttaaaaaatttttgcccaaaatacccaaacctagggggtttaaagggtatatggcccttttcgggaaaggaaaatggcccggtaaaac

SEQ ID NO: 6019 - DNA, 401 bp, Bacillus thuringiensis
tttggacgaaatactactctagattttaccctatccatttaagataaacagcacgggaaaccactacataacgatggtgccatggctaatactgaatgacagcgctatgctatatatcgtttggactacgtgagagtaaatccatattctggagcgctcttatataaccatatgaatgcatcggaaggcggaaaattggcatataaacgttcgacagtggttcgaactctgaccgcgatactgtctaacgctaatccagcatggtgtagacttgcacgaggatactgaagataccacactgtcttagcactagcctatctattcgacaagcctcgagatttataggtatcatctgaaccattacactaagtgggatgtaatcttatagctcgataacctga

SEQ ID NO: 6020 - DNA, 252 bp, Bacillus thuringiensis
ctatatgaaaacatcatgccctaatatttctggggagatggttcataacaccacacgtattcctgtcgatgtcagctgtcagctttggcgttgctgaaattatcagcgaggaacatctcccacgtgctgaaaaatgaaaactgatgcacacaataaatctacagcagataggaggggacttggtacaagtacagccattgcttgatcatgggcgatcctatttaagcacatctgtcatttcatgacatccac

SEQ ID NO: 6021 - DNA, 102 bp, Bacillus thuringiensis
tcgggagctcattttcgcgccactacgccgatctcggcaaaatcttttataaatcaaatgaatagaccgctcgcgggagcgctgtagttccaattggggacc

SEQ ID NO: 6022 - DNA, 143 bp, Bacillus thuringiensis
ttcggaggctcttaaagaacaaatcatttcctggagcttcagttgttcgggataatactgcacgacgcaaaaacggggatagcatcatctttgttgggtctacccctccaacagttcaccatatatataggcaagcaacacca

SEQ ID NO: 6023 - DNA, 384 bp, Bacillus thuringiensis
tatttaaaccgatggttcaaactgaaatttgctttgaggcacatatgtggacacgggcgagggatctagttaagaggtaacgcatcaccacggcaactatgctgtagccatcctgagagggggatcggacacactgggaccgatacacagaccagactcctacggaaggcatgaaacaggaatcttacacagtggactattgattgacgaaacaacacctcatcagagaggaaggcttattgttatgaacactctagcgctagggacaaacatgtgctatgcgaataagacgacagctctacaggacataagcagaaagccacgggtaactacgtgccatcattcgttgtaagacaaaggaggggagcgtcatccggattattg

SEQ ID NO: 6024 - DNA, 346 bp, Bacillus thuringiensis
ctccttttataagaaatttttataaataaacacccttatcccacaaatccttttttactattccttaattcacatacaacaaaactccattcataaaccctatattataatataaattctaattacatataaaatttacactttacctcttttataaaaaaactatttcttttttataataattgtttataactttataaactttacataataactcagaaacccattaatcaccactaactttatatcaaccctccttataattccaaaactaatattatattatttattttacattttatactactccataatttattattctatccaaatacaaattcataat

SEQ ID NO: 6025 - DNA, 356 bp, Bacillus thuringiensis
gctaagcaagcttgccaacgaatacagatacgaaaattctttaatgatatcactgcataagcaggggggtggcatttttaaaaacgggtttgtttatatagccgtgcttactaaaaggaaaggaataatacgatgaacgccatccactctactactattgcttatacggaaaaacctacaataacacccatccatcatagatatgcttgaatgccaacaggacaaaccaacgttttgatcggtaaacacagagcacttgcttctattaaaaactcaaacactccaggggactacttccctactgacaaaaacagagaactagaataattgatttccgaaggaatactactcgcaaa

SEQ ID NO: 6026 - DNA, 259 bp, Bacillus thuringiensis
ataagctacttatgtttatgaagactcgaacgggaagacgagagggattgataaaagcggtgctactggagcacgcccggaatcaactgcaagtgaccgtacaagccccggtccaaaaatatcacgtcccaggtgcgattaccaaagaacaaacagaagcgcagaaaggaactgattcggtagacccaccctcaaaggaagagaaggaaaaaccgcaatagcctggaacgaaacacacacaaaaggccccgaaagcacc

SEQ ID NO: 6027 - DNA, 395 bp, Bacillus thuringiensis
aggttggccaacaaataaaaaaataccctaattttttaacccttccccagcccaaggcaggggggatttttaaaaccccggcgccaaaaaattaaaacccgcggaggaaaataccgcggacaggcccctcccccccaaaacctgcgggtaccaaaagttgcggaaaagaaaaaaattgtaagccccaaactccagaagccccaccaggtaaaaaagaaaccctcgagcgggaaaataaagatttaaaacttacaaaagaccaaccaaaaaacaaattggaaaaagccccaaacgaaacttttgaaaaaactatttaaaattcccgggcaaccctcttaaagggcctaaaaaatgccaaaaacccccaggaaccaaaagccccaaaacacaaaacc

SEQ ID NO: 6028 - DNA, 353 bp, Bacillus thuringiensis
atggtttcctgcatccgcatctgaaaatacatttgtctatctcactaacgcgaattactggacgagaactgttattgtatcggtagtggtacattcttaccacctcataaaacggcaggcgcggttcctgtattacttatcgtgcagatgcgtacagtggagaatgcactaactacatataccttgtatgattctgcagctgcagttgcgataggaactgaatcgttatttcatccctgggacacccactggtcttcgtcatccgcgttagacctatgataacttgcacatataaaatcccccggggacctaggcctccaggagtgcctgtagctgccgttacaccctgaata

SEQ ID NO: 6029 - DNA, 150 bp, Bacillus thuringiensis
ggataatttaatcattaggtatgagaataaacattcttaatatctcccaaccaccaacaacccaggggcaagggcgaattttagaccgttaacacgatcctgacgcgaaaggggggtatgagaagaaacgagaacaataaaagcacgact

SEQ ID NO: 6030 - DNA, 245 bp, Bacillus thuringiensis
  unsure (1)...(245): unsure at all n locations
tcgacgaagcttgccagcaactagatagagtgccccattttttaacatcgaccaaccactgnctggggtaggtttcaaaccctagggacgggaatgtgaaagcactccgctagaaggtgcggcgctcagcataaggcggtcaagagagataccatcactcgctacatgctcgtagaggtcccatgcattaatgaatttactaggaattatgctctttataccagtcaaaataccatataatgtac

SEQ ID NO: 6031 - DNA, 272 bp, Bacillus thuringiensis
tgagtgatgagtttttttaattttgacataccattgtctagagtatgtcacaatcgctagggactgaaatgtgtaagcactcgcttgtatggggcgtgctcagcataaaggtgtgaagagagatactcttactcgctacatgttcttagagctgccatactttaatggatttactaggagttagcttcattttaccagtaaatataccatgtagtgtaaagtgcttatgaaagtagaggatcaatatcttatgtaatactcttatagccggc

SEQ ID NO: 6032 - DNA, 233 bp, Bacillus thuringiensis
gaaccaacatctaactgcgggggctcgggttactacaatgggactgtggtcataccttcataaatccagaatgacactgaccctggtatatttaagtagccagcccaactgtaacacccatactcactcgtactatccctactgaacaatacttacatttaaagcaataccatcttgatctgactaaacaaatggctccacgattacttgcacatctcacactacgaacacta

SEQ ID NO: 6033 - DNA, 228 bp, Bacillus thuringiensis
ctcggaagctaggcacgaatccagatcttccttttgaattgctcccaaccatacacactgttaagtgagcgggcgtacattataacaccatgctcatatacaagccccttcggtgttcctacataaggatacgacgtgctccttattctcatattcgtggtgagaatgagaaaatacccccgccgtattatttacaacgactctcgttgtataataacatcatgtaat

SEQ ID NO: 6034 - DNA, 294 bp, Bacillus thuringiensis
cgataagcttgcttgccaactaatatactatcgaactttttttgctgttcgtctaaaaatatagggggttttaaccaatacgaatcttctccgcccacaaagacagaaccacccggtccaactggcaaaaatccagaatgtgctacccatgcgggcgttcattatggttatactggacatgggggaggttttgttaaccttatcaaacaaacatctggacaagaccctaacgctattgcatcatgcagatcatcaaaattattcgccaacacttcaaatgccattgattttgtc

SEQ ID NO: 6035 - DNA, 235 bp, Bacillus thuringiensis
ttattaccccccaccctcattcacctttaattatatacctaacgggggattttataacaaacctggggggctccccacaaccatcattcactcacacaatccctctcatattctacttaccaaaacttccaacctcctacagacaatactctcctcatatcccctacattatcctatggtctcacccatcatacccttcctttaattgattactcctcatttcttacttctctca

SEQ ID NO: 6036 - DNA, 340 bp, Bacillus thuringiensis
gggggggggattttaaaagaatcggtgtcgaaacggacgtgagatatatcatcgaatctggctactaaaaatgaagcgggagaagagctgatttttgtatagacactcgtaaaaacaatgttgctgttactgcaataatggctggagggaggaagactggaacaacaaccactcgctgtggtcgctccaataggactaccagatggccggataattacgagagatcacatagctggacaaacaatcaacagaccggttataatcgaagcccttggagcaacccatttttcttccgggcttacgaaaaaacgaccgatatgtgaaaatacaagaacgacaa

SEQ ID NO: 6037 - DNA, 222 bp, Bacillus thuringiensis
caaattaaaaggacgattctagggagggaatattgaaaatcgccggaatggaaccacttttaatttacaaatatgtgaatcacgaggatctgacgtcaggttaacaaaatctacaccgctattttttatcgtttaaaaaagaaatattaaattgtcaccaaaaaatggaattatactgaataagaaagtatgaatgggaaaaactacattattccgacaaaa

SEQ ID NO: 6038 - DNA, 169 bp, Bacillus thuringiensis
tcctaaatcaggcaacgacactttctcatcatcactatttgatattcctatttgaacggaactcgtcgctctatttaataactttgcacctgtcaagctcgaatagtcaaatgcatcaccttatggcaactctatccttagcaccatctgatctcagcctattcggaaa

SEQ ID NO: 6039 - DNA, 133 bp, Bacillus thuringiensis
ggtttaaataaaaaggccgggcgaatacttaccaaaattttaaatgcacatccaaatttatacaaggttctgtagaaccattccaacaacaaacaaatgaaacacctaagacaaataaaaacttcacccatat

SEQ ID NO: 6040 - DNA, 286 bp, Bacillus thuringiensis
tcacatgtgttttacgggcagaggacatgacttgggtacggggaccgttatttatcactggtgtacgccctaggctgactagatcatgagcaccgcatatacgggtgagaaatgcggctatgacattattaagtagaaacggacctgcaatcgccctacctaaggatgggggataatatatagcgatagatggtaatatggtcgcggactcagaccgggttaataacgaggatacaacaccgattcatgatggtcgcagcatactcgaagatcccgatgagtcccc

SEQ ID NO: 6041 - DNA, 315 bp, Bacillus thuringiensis
ctcaaaaccttttcccccaatttattttggaagggtggtattggccccttacaattttttttggagggggggtttttaaatttttttggggaaaccattttaaaaaaaaggggactggctcccttgattttccaccaccggaaattgtttttaccagaattcgttttacctttattgcaagtggaggccttttttctgccaacccatcttcaacttttctaaatacttttttaaccattacctatgtttttggggttatcgggggccccacaaaaaaagcttaaaaccaggtttaaatatccgttattttttttt

SEQ ID NO: 6042 - DNA, 287 bp, Bacillus thuringiensis
aaaacagttagatttctcagtaatacccctggtaatatagcgaacggggagccaaatcaaaatccatgctctacctcccatatgcctatatatcgcatttctaccctgcttgcattagtctaaaaaaatcttataattacattatccccatgcactctactaatgagtttcaaacaatataagggaacgcatacccgcatcacgtgcactataacgaagccatctacaaactcgaacagtccacactgcactggcttccaaatcccctttatccataagcccgaaac

SEQ ID NO: 6043 - DNA, 390 bp, Bacillus thuringiensis
agcgacaactttttgttttggttcatgtttcttgaaatgagggggggcgttacagagacaacgttgatcaacccaccctttgaaaggggttggtaatatacttctgtgtcctttgtttggggcccatttttctaacctacaacttggggctcgatttattaacaattcattgtaaattttagaagaagaatgatcatcttctcgatgcaatacaagtgcaagagagccaatgtttcatgcttagcttttcggtagttacgtagtcacttaataaggaaaaggtccgatttacgtttttcccatgcctcttctactccttttttcacatatagagttgctttaaacattaaatcacccttgaattatgccttgcgctattatctttacacc

SEQ ID NO: 6044 - DNA, 185 bp, Bacillus thuringiensis
tgtatcatcaaccggtttgattttccatatagggccaaacacatggcggggtggtggggatccactgtaagagccaggttctggtacacagaaataccgcaccattgtatgatcgagcgaaacgcaaaaagtgcacgtatttgatagctgctacattattggttagattgctgcgtacaaagatg

SEQ ID NO: 6045 - DNA, 340 bp, Bacillus thuringiensis
cagatggctgtcaatacgccgacgacttaaatccggaattttttcgacacgttattcaatctcatgtgcgctgcggttttatagacagctgacggttctacagcaacattcaaccacgcacctagcctctctattgacgggaccacttgaatcactcaggggaccttatccaatatcttttgtaaaggctcgcaaggattttcagaccaaaacatacatcgcggcgccacatgctcggctgataccattcttactattgacgttgggcgtgctgcctacaataacaattacgctaaaatatcttgtcgtagagcacagggccggatgtaacacgtaaact

SEQ ID NO: 6046 - DNA, 231 bp, Bacillus thuringiensis
ctccctttcaaacaatttgggttatttaggatatttcccctgctccaagcgcgggttctggttcgagagcatctggcgctatttttagcgaatacaaaacatgggccacgtttgggcccctggatcgacaacctgtagcaaagggaatcttgagagttgctataactcactggggtctatgcatccgctcctctagactctgtgggcgggacaccatggggagtcctacga

SEQ ID NO: 6047 - DNA, 520 bp, Bacillus thuringiensis
tgattatgcccatcaacccatggattttacaacgccccaaatcaaaaaaactgcagcataatcaccggactgggcggattttaaaacatatttcgatcatgcagccacgctaggcctaccaggcggtacattattaaaaggcaacattagaaacattccgcacaccccggaaacggaagtacgacgtacactaaaagaagcataaggagaccaaaacggtcatcctaggccaccagtagtagaaaatagaagaaccaccagagatggaatggcggagacagtgggagcccgacccacgtccaaaattataggcacttaggctcacacgagagtacacgaagtatgagcatttggcgaactcgacggactagcgacaggcgaccaagttgctagaacggaacgccacagcctgagcaccgagacggagaacgccggcgcagtccatagactttgcgttcatgacccgaccacatggaccatggagggaggaacctttcgagcactaaagcagaggaagaaa

SEQ ID NO: 6048 - DNA, 393 bp, Bacillus thuringiensis
agcttaacttgcgtctttgcaccggacccgatttatgatgggaatcaggtttattctgacgtccattatatttgggaacgcgaggatgcaggggtattttcacgatcgcgttgctttgccagttttattgcaaccactcaatttggctgattgagggacaatgatggaggaactgtttacgtacatacccttactttacttggcagatgcaatgatttgcatgttgattttgcgtagattcccataattaggcggcaaaacacctctttcccgctcagagaagtcaactttctttagcggtggaacagctgcattggcactacaggatagttgtatgaggtatttataaaccacaaaggtgctcacgctgattagaccgacagactgtcgcga

SEQ ID NO: 6049 - DNA, 284 bp, Bacillus thuringiensis
aatttcaggaacctgttatatcaagcccaactacccgatctttcacacggggatcttttaaactatccaaatttttctcccacacgaatccacctctcattgaatattcataaccattttaccacattcaccctactaaaatccgtattctacgtatacaccgccataaatccaaacagaacaccaaatctaggctctaaagcacaaaaactcaaaatcctaaaatcctacggaaataacttagcccatgattgactaatcggcactctctcaccattatccat

SEQ ID NO: 6050 - DNA, 266 bp, Bacillus thuringiensis
ttgtgaaagaaatgttgtaagaagcgaaattcggcgcggcaagtaggggggtttttaaagaagaggtgggagatggacaagaatataaattaatggcataagcgaatggaacaactggacatcccaaagataatcgcccaagatcataaaagaagcttttgatggggaaaaaggggccaaaaaacgggacggaaatggggtgaataatttctccaggagccacaaaattccagaaaacagcaggattaaagaaggcgaattcaaac

SEQ ID NO: 6051 - DNA, 112 bp, Bacillus thuringiensis
catatcattacacagctagtatttacaaaacactataaccactaaacggggagcctttttaaaacgaataccggtcactaaacccacatgaagccatagaccaaccccccct

SEQ ID NO: 6052 - DNA, 225 bp, Bacillus thuringiensis
ataatcaggcgataattcttgaaaaaacacgtcaacacaaggccagaggggggccataaaccgaaacaggggcactaaacacacatgaggacataggctacgaccccctggcgagaaacaaaaaaatcgaccctcaacaaaaagggcccaaaacccgacaggacgatgaagatgccaatcgattcccactggaagactaatattgagctatcctgcagctaccct

SEQ ID NO: 6053 - DNA, 451 bp, Bacillus thuringiensis
gagatatcgatccctgatcgataatgaatcgcggtttcatattggacatcaccgtgaataagttgttcggaaaggcgaggtacaaactgaatttgcaaagcaacatctaaaatagcacacggcttcaggaagttatgaacatctcttcatatctcacggaatacacggcgtaaataatgataccaacgcactcatgcgatcaaatgcctacaggtggtcaagttgtgcactcttatagccacttgcaggctatatgcggacgtaacacataagaggactaatgaaggtctacatggtcacctcgcaaaaattgacgataaggtgtcagacgccatgtgtgaataaggatatagaagggctgccggatcagaatcctactcgctcatatgtcgaagcaagtgtgggaagtcagagtttttagcacaaagaattggagatcgaatacactcac

SEQ ID NO: 6054 - DNA, 209 bp, Bacillus thuringiensis
ctcatgtgaacacggctttgatttaccagataacgaagtcatcccccatcatgaggtcattccagtggatgttgctaacacttcgattggggatgctttaccattaggtgtcattccaggtactttggcaagtaaactattaattgctagccacactgtttgccgtatagaaccgccgcgttgtacgcacctgattgcatacttgaacg

SEQ ID NO: 6055 - DNA, 227 bp, Bacillus thuringiensis
gaattcgtgatcagtaaagattttaacttcttttttgcttctataagacggaacggcaagagtatgaggcatagggattactcgaccaatttgcccactatacaaacaaattgttatttcaacaaatcactgaggttcatacgatacacttacacattataattactatgtcccattatgctaattacacaattgcaaaaaacaactaatcttttaaacactaccac

SEQ ID NO: 6056 - DNA, 616 bp, Bacillus thuringiensis
cccttggggtcaaaggcctgcccgggcccggagaggctggcccccaaatcaaattttttttccaatttgatttcccggggccggttttttacccggggggttgggaaatatggtcccctctgggttaaagggaacccatttttttttaattcccttttggggggatacccccttttttaataaaaatttaaagccggctttttttacccgaattcctataattgggccctggaaaaccccccacctttcgggtttttaaaaaaaagggtccaagttaaccgcgggttttttaaaaagggttaaaaacttttttcaaaggatttttttgggaacctgggggcataccaaattcccctggaggaggtttggggcggcccgaaaacccaaaaaaatttttgttgtgagccctccccggtttttccctaaaaagggggttcccgcctttggccctttttaaacctttggaaaatccaaaaaattttggcaaccaaatttttcccccctttccacttttgggaattggggggccgggttccccaggggcttttttgaaaaaaggttaaaacccctggggccatacgtggaaaaatccccccccccccaatttccccaaaaa

SEQ ID NO: 6057 - DNA, 327 bp, Bacillus thuringiensis
agacgcgttcgaggcgaacacgatgcgtgatgatagccacgggcaatacctcttgctaggtgaggactactaaccactgctaaacctgaaggcacgcgagtattatttcaacacgactccgatttcctagaaaccgcccgcccagatgaaaaagaaatccgcggctgccaatacactgtcgcaaatgtgatctgagaagaagttgatgagctgtcacttttaccacgaagaggcattttcctactatcagaccacaaagcgcaaagggtctccaactcgtgaccacatcaagacgctgaaagaatacggacgaatagactccttcaa

SEQ ID NO: 6058 - DNA, 292 bp, Bacillus thuringiensis
cttgtgggtttttggactaaattagcaacgacaccacttcatggccctgtatcaccccacgctagtggatggagatagcaaggcaattgaacaggtattgcaattgatggacaggacggttaacttgccaacttaactattgattgctcgccacgcagcgtaccaactataacccccgcgctagatgccgctgctagaaagtgtgagcgggaccaaataattttcgaagacataccaggggactttggcgctgaaggtccgaaccgttatgagcccgaaaatatacacctat

SEQ ID NO: 6059 - DNA, 159 bp, Bacillus thuringiensis
aagccgcctggctcggagcttgcgacaattcgattaatggttaaaaatgggctaacccatgaagggcggggggagcgtttcggcgttactcctcccccggagagaataacctaaatccgcgttcggtgatacgcgggtaaatcactccggactgtacag

SEQ ID NO: 6060 - DNA, 196 bp, Bacillus thuringiensis
ttgtgtccaatgggaacatgagccgagtgttgaggactttttactcctactacatatggagccacatcgggattattggcaaactactactgcgcgctataaagctctagtccagatcctaaaggcagcggcgactgcaagtactgcatccggaccgtgtacgcaacccatgttgaatggctcgactgtgcaagac

SEQ ID NO: 6061 - DNA, 304 bp, Bacillus thuringiensis
aattagatctactagacaaagctatatttacaaccaacgaagtaacagcccgtatgggggcatgccagaggaggttgcaatcaagacatttggttatgaaaaagaatctggagccatggcctgcactttgagacataaaatagtacttgcttaccgcccagtttaccgactagaacagtggaacgtgacgcacatgatggtgcatatagaccctgccactactgtttgccttgaaacaccatgatacgcatttgtgcgcggtactccaacaatcgctccccgattgagaggacccgttggtttt

SEQ ID NO: 6062 - DNA, 191 bp, Bacillus thuringiensis
aagagaacatcagctgatagatgaagaccctggactacaactacacctgcagcaacaccggggggactttagaaggaatacgtcgcgctataaaacacaagaccaggttctaggggaataggtgactgccagcactgagtcaggaacgtgaaaggaacaactgatgaagagctttactgtttaagaagagc

SEQ ID NO: 6063 - DNA, 409 bp, Bacillus thuringiensis
cttatttgaacacggttttaatttacaatgtaacgaagttactgcccattatgatgacatcctagaggaggttgccatcaagacatttggtgatgtattacaatctggggtctgcccaggtactttaacaaattaaccattacttgctggccgctcagtttaccgtatagaaccaccgcgtggaacgcacatgattgcatacgagaccgtgccagaagaattttcaaatacagacgggggtacactcatcactgaagtaccgaacacacatgagcccatagtcagcaccgatgcatgttaacatccaacactcgttgaaaaaaatgtatcgatagccaattatagtcatgtgctatacacatacggtacaagggagactgctgttacgtgatttgctaaaggagctgca

SEQ ID NO: 6064 - DNA, 406 bp, Bacillus thuringiensis
cctacgaaccgccatcttgtcttggatagcctgacgtgcctaatgagcgatctcacgtaccttgctagcatctgacacagtgcccgcatgacagaaccaacacctgtcacgccaaaaaggtaaatgaatgctgacacgctcgaatcgaggcagaaagcgtatagtgcgctcttatactttgtatgtaaccgagctgggtgcaactcggtttgcaccgatgcagaaagcactatcttttcactagctggcatcaacacagctagtctcagccgcggcatatgacacatgacagaatctgctgctgaaaagacaaacatatgtccggcaccatacattggatacttatcagtcgcttgacctgaagaaacaatttttggccatgcagcaaagacatcatatccatgat

SEQ ID NO: 6065 - DNA, 411 bp, Bacillus thuringiensis
cttagtctacttcatgcttttttgaatgactggaagcacacaaagatcaatataaaaaatacgttgtagagattaaatatattacctatactaatgttgctctgcaaaataaaagagagattggacaacgagtgtaacatgttcataatgcatattatatagaaggtgacaaggatctagtgtagatgatgagcaagcatgaacaaatttatacagagatgagaaaatctatcgatcataaacaattaaaagagggatgcaccatcccaggagaaacagaattaatgaagcagtatgaggcaagccgaggaacgggaggaacagctgcagacatactgcgtgagccaggatcatggcggaactattatggaaaaggcgtttttgatttaaagcgtaaaaatatagaatttt

SEQ ID NO: 6066 - DNA, 353 bp, Bacillus thuringiensis
gcgacgggaacagatagggtggcggtttttatttgcccttggcttttcaacacggacgccatttacattaggtggacaacctttcgaggcccgcctaatgactgggcgatcagacagaagtctacataattgaacgctccttctatcccataactctattcattcaccaactgaaagtggatgctcgaatgacgctggaaagaacgccccaccctttgagaagacagtatggccactacctatggacacaccctgacctaccaacatgcgcatgccttcccataagcaaagcgagcgtgctgatatgcgaaccacatcccaacctacgctagaatcaacggagagtgtttcac

SEQ ID NO: 6067 - DNA, 418 bp, Bacillus thuringiensis
cacgcgggctaagttgcctggctcggacgcgctgggcagcttgcagacgaatatagattgttgggtattaagtcaattacaggagtgtcatgctctctgtatgagaccgttcaagaccacgtcgatggctcacttggaaatcatgtgtgggatccgatggcgagcgtgcaagcggcaaatgagcgcttcggatgcaggagagctactggtcaaaacggctacattttgtggacctgtccatatactattaatagactctacggctagattaataactacgtcaatagaagagagggggaaggcttgcaaatctggtgcgcatggtacataccggccgtttggaccggaagtttcaggtgttttaacatagtggagactgaaagcagcagatcctataggaatagaaaaaggacaaagg

SEQ ID NO: 6068 - DNA, 368 bp, Bacillus thuringiensis
  unsure (1)...(368): unsure at all n locations
gctgaagcttaaacatagaggcacgactttcaaacacgaaggagcacgcagaacacggagaggattttaaaaaagaaggcgcgtgacacccccgcccaaagagaagcaaccgaagaagcgcccaacacaacacccaggaccgcacacgccccaaaccgagaacaaaccacgaacgaacacgcacacaaccccgcgccagaaaaagagggccgcgcagcccgccaccgcggagcgcggaaaaccaccgaagaancacagacaacaaacacacccaacgggccagaacaccgaagacacacagaaggagacgccccaaagaaagcaggcaaccccggagcgaaagaaccaggggcaaaaacaacgacacc

SEQ ID NO: 6069 - DNA, 378 bp, Bacillus thuringiensis
tgatggattttcagtagcgacagaagcgagatacatccttacgagatgctcaggatattgatagttgcagaaacactagccttgatgtgaatcagatgaattacaaggccatacagtgattacatatgcatatagaacactatgtctgtggagacgatacattgtaactttaaccccctagggagtcagtagtgcatgaaagaaacgaggtatatcgatgcacacgatgtgtagtacacaagaggttcagtatctgagttacaatgcgcaagacaagcgggcagcaagatatggctagccctgcagggagcgagaacatggaaaggatgaagggtggccgataattattcataaacacctcataatattctcggctga

SEQ ID NO: 6070 - DNA, 312 bp, Bacillus thuringiensis
ccagcccgttctcttggtacaagcgcatctatttcttcatttaggggcggaggtgctcactgctcgctctgtttgacctctgtatcaacaggatgtggaattataatcgcaatgggagagactatcttcgccgactatgcccgctgctacccgcatcgacgggtactcctatcatgcgggatggccacaccaaacggtgggtcaaactatgtgtagctcgagagagatgtaggagacctgcgatatggtaatgcacgcactgcacgacatgcaaccgtagacgtgactggaccgcgagctgcacgtgcacgc

SEQ ID NO: 6071 - DNA, 302 bp, Bacillus thuringiensis
tcggaaaattttcgtaatatatgcaccgaaattatttgctaacagcgatggcttctgcctaaagaggggagaaaacaatgactgatgtaatgctcaaaatagagaattgcgatgttgaacgactaacggtgtaccatcgataatagcagtatctatattagcaatgctattgaaagctctgttatattagatgaaagagacagcttattataattcaattaatgaaccgctatctagggaggctaatgttaatagttatgagacacttgtaacctgttagagtgcgctattgggggagacaa

SEQ ID NO: 6072 - DNA, 360 bp, Bacillus thuringiensis
  unsure (1)...(360): unsure at all n locations
atccatgaacacttacataaatatcatcaactggatatgattttggacaaagngcagcaccaccagagggagacatggttacagtaccctgaggtactacttctgcaggtttgtttgcagaagcactaccgttcaaaagtgaaaaatctgcgacctatagagaaactttagctgatggtgcaatggataacacagaaggtaacacagcgacacacactactagtactacgactagcgctagcaactttcactttaagtctgcaatagacaatagaaagcccattcatttacgacgggcattaattgatgagcctaatgattaatcctaaaataattgcacctgcaagcggaacaatataa

SEQ ID NO: 6073 - DNA, 346 bp, Bacillus thuringiensis
ggggttttcttggactcaatcaaaagtgcctctaggaatatgagaaatctgttaggcccgatcgaaacggcgggccgcacatgagcgaaactgctgtaccccatcacccgatacaagaatgagaataggagcgatccataaacgctttgattcgagtaaaccagttgatggtccaggcgtgaacttgctaatgctacggtgatcaggatcctactgcggattgggaagacgaagaggctctaccattaagtataacgcctggtaaaatatcaggggagacaatgcacctctcttcacctgctcggagctggaaaaggggagctggacgtttagaagatgatagaac

SEQ ID NO: 6074 - DNA, 129 bp, Bacillus thuringiensis
atgattgcactatacttcgctataccaagtttatttctaaccgacggataggcacctggggggagaaatattagctgaccgctttccaccacctcaacgacttctgggggcgcctagactcacatccat

SEQ ID NO: 6075 - DNA, 429 bp, Bacillus thuringiensis
acctttagccgcctcgatccagcctattaaatgttttttcgaacaccgccgatcatggcggccggttgcgtgggtcgcgctgcgttgtcctcatgcaggcaaagaaccaggtgccagccgcgcatcgcgcagcggcagcatgatgctccgggaactaaggagagttactaggcctacgagagctactatttcttgacataatattagcaatcacggggatttaccagctccggggactccgacaatatcgaggcgatcctgtgctcgaacaacccattgtgggaacggaaacagcgtgcgatcaccaaagaccttatcaatactactcgcgattagaatagacgtcagcaagccttcctagtttaactagagaggctaaacgtcacccgggcgtgtaaaaagagcccacataggtaaacgagtttttac

SEQ ID NO: 6076 - DNA, 134 bp, Bacillus thuringiensis
tctttgacctttcgccccaagaaagacaacagggctctagtgtcgcatacaccagaaaaacactgaataccgcttgataaaacggacaggaagacgaaagcctgcgcgcggatgtctgataaaacggaacacgc

SEQ ID NO: 6077 - DNA, 441 bp, Bacillus thuringiensis
attccgttgttactttatttaatatacaacgcttattcgctgaatagacagcgacagggaggatggtgtttcttatttgccagagactaaaaaagagggataagatttccggttgtttggaatcctcagactctcgttgatattgcgcatctcatgaatatgaaatattaatcgctaatgttataaaataattctaattttgcaactaacgagatgaaaatcatgtattcgtctattataatgagccacaactttcggagaaatgttcggcaacaaatccattgagatgctgtggtatctatttttctcccatgccttgccatgagcattttttgtgtgcggccggctgtctccacccatgcgttcgtgtaataacgaaccatatgggatcatgtccacggcgagttagaacctgccctactagatatagcgatgcatacg

SEQ ID NO: 6078 - DNA, 220 bp, Bacillus thuringiensis
ggcaaattgcacgcgcggcgggtgaactttaatcaaaaatggcgtacaaacacctctcacatacggtagacgtctgctacactggcaaggacctgagcaaagcgcctgtagaacatgcactggcaccaaataggccgtgcacttcattgccacaggtttactacgctttgacacaaaaaccgaaagtgctaccgaactaactaagcgagcaaaacaggcc

SEQ ID NO: 6079 - DNA, 347 bp, Bacillus thuringiensis
ggagcgattatatgaccaatacaagtacggggtgttcttatcacacaagaagcaccaccaatagtaggttgacttacagacataacgagctcggtggacatgcagatccgaacagaggcttgaaaggcactatcgagaggatggattgcacatacagaacgaatgtggggcagggaaactagacaggtgtcattggcatactccggaggccatccagtaccttcatgactgagaccaaggtgagtatggacatcaataaaacctgaggagatatggagtgctcgtgcatacatagcggtcagatctagtgccggcggaataacaggtatgacctcgaccattcctta

SEQ ID NO: 6080 - DNA, 408 bp, Bacillus thuringiensis
cagaagcaaagttttgttaccttcaggcgcacattgttcacagcagcgaatagatagtgtagcccattctatggaataaacgaaggtggcttaacgatgaaaaagtgttgaacgacagctctacatgaataagaacaggagttcaatcatcagaagcacgttctcttatcaggattgcggctcataaaaaatacactagttacatctgatggtagtggggttcaaaagtctgatgagcctcatacagatgatgatgatccaacgagggagatatgacaggatcacactataagattctagagcttgtattgctttagagaatgcacgctgaaacagtgaaagaacaacatgcacagtatagagctggccatctaacgacctctgttgttgatcggctataaccacaca

SEQ ID NO: 6081 - DNA, 128 bp, Bacillus thuringiensis
cgcaaatttcaaggaccttgtccgcacagaagacaaagggcaatattggaccgctttgaccttactgcaaataccttcgatgtggactccatggactaaagcaagcttatccataactcgaacaacat

SEQ ID NO: 6082 - DNA, 253 bp, Bacillus thuringiensis
  unsure (1)...(253): unsure at all n locations
gaacctccacaacgaagcaagcaccangagcaaaggggggatcttaaaaaaccaggccggcgttaacccacgaaaatcaacagtacaccaagaagacacaccaacggaacgggaccaaaaagacacgcaccagacagaaggaacaactaacccgcgggaaaagcaactacagaagacacgcgatcgcggatagcaggacaaatacaagcaaaaaacgaatcaacccggcacaaaaacactgccagcgcacgaa

SEQ ID NO: 6083 - DNA, 534 bp, Bacillus thuringiensis
ttttggttcccctttagttctgctgtccaagttccttcttcaccttgttgcatgtttatttcagcacctattttatcgttccagtttttatatgtaactaacttcgcttcgcttgcagtaggagcccataaacggaactttgtatgttgcggagtatatgtatttcctaaatcgttgccaccataataaaataaattatcaaattcttcgctacgaatgactttaccaatttcagtattcgtatcagctaagttttcaattttaactttgtatgtttgttttaaatcaattttctgttccgtaattattttaacctgattagtaatatctccactgtttgtatcataaggagtaatatttttaattttaatgccttcaatttcaattttcttttccttaatatgaaacgggacattagtcgttacagtaatttcattgaaactatcaatagttgctttttgaattgagagatccgatgaaggcttagagttatataccttttcatcacccgaaagaatccatacttcagcacga

SEQ ID NO: 6084 - DNA, 346 bp, Bacillus thuringiensis
ttaggggattgtcatcgatggaatggacgcggggctcatttgtatcttcgacagaaccatccttgactccaggataatgtactaagcaaggagcattaattctatgatgattcttatctgtaacgccattcacactattgataggacttttactgacatttatcccgcttgggacatgtatgattttcgcttgctcgtatcaagcaaatcgatcgtcttaaaagagaagatgatctgagagttccccttaatgtagatgctcggaggacattgttgaatctggaaatgactctttttaacatagaaatgagcttatagaatgacaaagacgtcttggaggtcacca

SEQ ID NO: 6085 - DNA, 231 bp, Bacillus thuringiensis
gaagcgaaaacggggggggtgtattagaagagccctgcgattccccccccaacgaaacaaatgaccatgccgcgcacaaagcccgtgacgaaaacaaaccaaaaaggaaccatagcaaggctagctccgaaaagctgggaaaagcaaaaagaaaaaacattagacgacgacgccgcaaaagaacaacgctgtgaaacgaggaagaataagcgatcgaatggagcgggacca

SEQ ID NO: 6086 - DNA, 301 bp, Bacillus thuringiensis
cccgggctcgcgaagcatgccggcctactcagacatacccaaggactttttgccaacaaactctcacaagctccggggccctttttagcgtcgcatcaagcgactcgcaggacggacgtggcgactcgcgacaggacaatgaagattccacgagacctcccctggaagctttaaaccacgcgctactgttacggccacgccggcaagcgtatacaccatcttgagtgccctttggatagcgaggcgaaatcaataccctaagcctgtagtagagaacaagcggagtagttagttcgcttgc

SEQ ID NO: 6087 - DNA, 297 bp, Bacillus thuringiensis
ccccccacatgcgggttgatctagcctgccttcgctcggctagctggccaactcatacagattccttatcgttttgtatgccacacaacagcttggactgatatttgtgaccaattgcacaacgacgccatgatctagctctacctgccggctatgcagggaatcttacactgtattggcaaggcttctgtgtatatctgaacgaaaaacgttatatacagccatgaatttatggctctgcacactcaggggcatctccgatatgatcatgggcatgtgataagacgaggctgaaac

SEQ ID NO: 6088 - DNA, 337 bp, Bacillus thuringiensis
ggctccaccaagatctttttctatttgggctaggggatgctctttgaaagcgcggtatcagttcagcgcatgctttctaaccttagttcggctaagctagctaggccccccggaggatgccttgacactaggcgccgttcatggacgggacccacaccgcgctgcttgaggtagctttaatttagctttgtttcccagattttcgaatggtgaaacccagcactcgaactggcgtgggctccttatgtgaacacctaaggtaagggggacagaccccggggacccagacttatcttatcccgcaggaagagacagctcatgcgatttcctgtgatag

SEQ ID NO: 6089 - DNA, 273 bp, Bacillus thuringiensis
gtactttttctttagctgacgcaaagtagcgaacagactggggatttgtgttgggatacttacaacctaatcttaggaatggcgtccagtttcgtcacgcaacgagcgtaagaagcaatgagcatgacccgaacgcttggtagttatgaataaaggagcatcaaattcaaattggtacaccgaaagaaattttcaataagccgtaaacattgttcgtcggacataataggtgacctgcatttctggaaaaccggaaaacaaaaacaagcacta

SEQ ID NO: 6090 - DNA, 267 bp, Bacillus thuringiensis
tttgcatttcctgttattatttacctcctaaaattcatcacatgggtttatatgatttttaacatacatgcccaacagaatgataacgaacgttgttactctgtaggcagttgacacaacatatcctaatgactccaaggtaatatacgccgctgccttgtacgacgttaacaccttgatctttcgctcactggtcaaattcccaaggcttaattgtgttacacacgccgtaccttccagccaagcgccgataacttgacctatcgc

SEQ ID NO: 6091 - DNA, 255 bp, Bacillus thuringiensis
tgcacgggagagagcttctcccttttatcgataacggactaccgtctcagtacacgagtcatgcggacgctaacgtagccattgcagttcgagcattaccaggccaccacaagatcatatatagtacttattatatctgaacactctatgcatgccggaggtgtattggaaggcctagaaccaagtttgccaactaatgggattaccattgggccacaagctgcagcacctgcttaccccaatgcatactgcata

SEQ ID NO: 6092 - DNA, 237 bp, Bacillus thuringiensis
agaagaggtctacactctaagcgcatgcaaaaaagcccgcaggcagtgggtgtactagtaagcgggtggggaacaaacacgccaatatctccgttacagcctatcctgaccaaccgatttgtcatccaacggacgcccgactgtacggtggcttgtcacacacaagaatgacccgaggtggctatcaatgaagatccacttctacacaagatgccgagaaaacagacctcggacccc

SEQ ID NO: 6093 - DNA, 102 bp, Bacillus thuringiensis
tttgaaccaactacgcatgacataacagggggtaacattgagaaacaactcaggggcgaccctaacgaaagggcgccacagggactagacataccaatgcgt

SEQ ID NO: 6094 - DNA, 148 bp, Bacillus thuringiensis
acttgtctcatgagtcggattcctactttgactgcattttgatattataaacatctggaattcagtcctcggagcgggttatgcctatggctcgcctcttgaccacacgctgtggggtgcccgagcttcgcggccgtatgttttctat

SEQ ID NO: 6095 - DNA, 331 bp, Bacillus thuringiensis
gcaacatacctttcattgcaggtaagcaacaacgatagatcggaggggtcattaaaatgcgtgcaccgtatcgtacgtactggcctagcacggtatacatgttaacgaaaagccatttgtaaaacagggtgattcacagacgactaacaaatagcgtgaagacatcagcaccttctttgaggcattagagaagtaccgcctcactgcgccggcgttggaacgaaaacaacccttatactgaagaaactgctcaccgtacaccatggcacgaaataattaccacacacacgcgccatattgaagaagaaatgcaccaagaacaaaagcactg

SEQ ID NO: 6096 - DNA, 175 bp, Bacillus thuringiensis
acatccacaaaaaaatagccttgatgtcccgaagtcaacaagaacagctaagcgcgccgaagcattcaaagcaaccagcgcaactggtgctacagactgaaaatgtgaaagaggccaaccaaccgaattaccgattggaagtgtgggagcggaaaatctataaaacatactaact

SEQ ID NO: 6097 - DNA, 122 bp, Bacillus thuringiensis
gtgcgcgatgtccgcataaacagatggtgccccctggcgaaccgattttgctcttaaagcagctgcataccagctggggggacttatagagcttaggtgctgttgatacaaaggaaccactc

SEQ ID NO: 6098 - DNA, 227 bp, Bacillus thuringiensis
aacggtcacaggatagttaatggggctaatagccgaatacgggggagctttgggaaacgatttacagcacctcatgaacaaagcgggggacactgatcaagtcgcacgttagctagaaccagtgacggaggaagcgagattacaaacgctggacatgcgtttcgaaattgggcggccaatcgaagcacgaagtggactcgcaattggcgtcagggcctggagaaaat

SEQ ID NO: 6099 - DNA, 186 bp, Bacillus thuringiensis
accaaccattttttttaacggcgagccaaggggcatggaaaacggagattgaagacgtgaatttgatgttgaaagtgaggataaagctatgcaaagcaaatgatttttgaccaatggacgaaatcggccaaatcccttatagcatcaaaggaatcgcccgagattgggactgagtggtgacccaga

SEQ ID NO: 6100 - DNA, 293 bp, Bacillus thuringiensis
caaacccacccttttgttatagaccaccaccagaagcaacggaggagggttaataaagagaatcctgcggtaccccccccggagagagaaacagacaagctgaaaacgaacaccacgaacagaataggcactaaacgaggcaaactagggagaaagagaaaaacgggaaagcacaacccgcaaaaggagaaaatgacgaaagcgcaatgcatacacacaatgaaacgagggaggaaatacgggaaaaaggaccagaacaacggcgacaaaggagaaaagaaatagatgaagaa

SEQ ID NO: 6101 - DNA, 123 bp, Bacillus thuringiensis
cggatgcgaatagcaggaggcgcgcacccagcgtttttccctccgcggcgcgccctgaatggccaaagcacattgcaagccgtaatgtcttgcataaattcttggcacctgttggtaaagagc

SEQ ID NO: 6102 - DNA, 153 bp, Bacillus thuringiensis
  unsure (1)...(153): unsure at all n locations
tgcgaccttttttttgcaaccgccgacagaaacgagggaggaggggttattgaaagngagatgccgtttagaccccnggaggcacgctgggccccagggggacagagccacgcatcgaccaaaaccacggaaagggcaatcgccgaaacgaaa

SEQ ID NO: 6103 - DNA, 152 bp, Bacillus thuringiensis
cacgacctttggtgtcaagccgaaacacgaacacaccacggggggctccttgcaagccctccgcgcatacccaccacagcaagagaaaatcatgcacagaccaagcacgccgagaaaaacagatgccaccccacaaatcgacacagcataaa

SEQ ID NO: 6104 - DNA, 552 bp, Bacillus thuringiensis
ccccccgtgtgctaaagacccccccaggcctggaagacgttggcccccaattcaaaatgccataagggtattttggtggaaggggtggggccccttcctttttattccaaagggttgttggaggagttggagaaaatcccgccccgtttaagaaaaagggtggaaccacgtcctttaatccaggagtttgttttcctacccccggctttattggggggcccggggaattagctttttgggggggattcccagcaggtttcccatccggcggttttaaaagccccccttgtggtccttcttttaacattcccttttggggggggggttttggccccggttttttcggctctcaattggagagaattggcccctttttaaaaggatgccaaaaaccggcggaaaaccggtgtgttaattcaattggggaccccgttggaggcccttttgaaagggccaaaaaaggaattggccgattttaatccttttttccggaatttggaaaagaaatatgccccgggttagggcccttttgcgggaaaaaccatttggaat

SEQ ID NO: 6105 - DNA, 378 bp, Bacillus thuringiensis
atgcgagcagtatttatgcttggcgcacataggtacccagctagtgcccttggcagaacagctggtacaccagaggtgcgtacatcctggtactctggtgctaaggacagctactctgaaatgtcctacgcgcacgctagataaggtccgtactgtctcacgacgtgctgaacccagatcgcgtaccgctgtaatgggcgaacagtccatgcattgggaccgactacaggcgcaggatgcgaggagccgacatctatgtgccaaacctgctcgctgatgtggtctgttgggggagataagtctgttatgccgggtgtagctactatccggcgagcgatgggccttccatgcggaaccgccggatcactaagcccgact

SEQ ID NO: 6106 - DNA, 330 bp, Bacillus thuringiensis
aactattatatagaacaccgtgtgctgacacaaaacacgagggggaacatatattgcattttcatatgggcccaaagaagttacgatgtctaaccatgcatatgacgatcgtaaaaacccttattataaaacactgactatcgcaggccattgtttgattacattgcgcaattcagacttataaatacgaactaatcgtagcataggagatatcaccatattatatattcttacttagttagaaaatgattcatgcctatggtagacatataactttctacatcgtgtgtcaaccaagaacgtactatgtacttccattaactttcactt

SEQ ID NO: 6107 - DNA, 339 bp, Bacillus thuringiensis
tacgccaccggcgaatattttttctgctggtggagcaaggacactcaccggtgccattcctgggaaatcagcataaacccgctactaggaagaggctgccctaagagaaaccgtacgtgatgcgctgacggagggcctgagcgcgggtgcattaaaattgagcttgcgaatgacctacaaacagctgaacgcatatataggttacgtacagcgcaagaaggaatgaataccggtcgggatgttacgagagagtttgcagagtgagaaatacggatggcctggagcatgaattcgctggcgagcttattgtgccacagatagttctagcccgcacgtgag

SEQ ID NO: 6108 - DNA, 206 bp, Bacillus thuringiensis
gttgaaccacgacccggcccttttagtatttgacctgcaagggcatacttcagggaggtttattcgatgaggaaataaccactcaaccccatacgagaaaaaacattgaaatttatgaacccaaacgcattaaaatgcactttgtacacggcagcacccataaccgtgtgccgcaaaaccttcttccacaaacaccgacgcaagaa

SEQ ID NO: 6109 - DNA, 182 bp, Bacillus thuringiensis
atggagaagaattattagcttacattaaattaacgaaagaagtatgagaagagtttgaagtgctttcttctgacacatccacacaagatacaagccgggggcatatagagggaagcctggcgtgcctactgtgtgtagtggctgacgacgaaagtggtgcgctcactggcccaaaaggacca

SEQ ID NO: 6110 - DNA, 316 bp, Bacillus thuringiensis
ttctgtcaattagaggcgaagaacgaaactcaattcttaatgtcatcttatcgctaccggtaagggctatggtagtagccgtgcatcttacaacgcgaggttgatgaatcatatatactctcacgcttctgagcgtgttgcatcacggcaagatacatggctcatgttatcgggtcgtggtcatagacgacgatgtacaagaacatgatcgtaacaaaattagtgactctcaatcctggaacggcgggaggtcttgcgacaagtgagttagctgcggttagcggagatcgttcagcataaatgacagtgaagttca

SEQ ID NO: 6111 - DNA, 251 bp, Bacillus thuringiensis
  unsure (1)...(251): unsure at all n locations
cgtgattgggctcggttgcttttacatcggataccaaggtaagaggttcaattgggggaacaaaattaccgctnttccactgtctccccgacctattagaaacagctccctcacccaatttggcaggaaaggatgtcattagagccccgggaggcaaccagacgcatttaccaccccaagcgaatacggcccttttataggctatggagcacgctgcgcacacaaacctacacgccggtctatcctcgcga

SEQ ID NO: 6112 - DNA, 205 bp, Bacillus thuringiensis
ataactggtgttatgggtcagacacatgtgttggaaaaagcggggatgttgtactaatagctactggcgctccatggtcataatatgagccacaacaatacgactgagctgaacctaattcctggctgcatgggtggtacctaagtgacgataaggtgggctgactaaaaccgggtctgatactaagagtaactgaaacctgtga

SEQ ID NO: 6113 - DNA, 312 bp, Bacillus thuringiensis
tgcagagaatgcacgcgcatgcataatctaaaagacaccagaaaagcgagatgcagcattgtccggaaaacctccggcataaatgcaacgcgggaggttataacagatatcccgcgttttaggctcggcaccatgaatattcagtgggattagaacgccgcttactgggagcgcatacccaattaaagacgcagccatatgggaagttgtaacaacaccgcattgagatgtggctggacctgagattgaaagacataataacgtgtcatgagttgtgcggacatggactggaggacgtgaatgaggatttaa

SEQ ID NO: 6114 - DNA, 368 bp, Bacillus thuringiensis
agatatcacactgcaaacattcaggggcataggactcgtccaccttattagaggtgatatactcgctgcgcgctctgaaggaagagagccgaaagtcttaactgcaaactcaagtggcagtcctgatttagctgaaggtgatccgtgtgaaaagccatatgaaaagcgatgtgtagcctcgcttctcatatcgtttcatacaaactgagaaacctgcgccagatacttgtgtctccctatcgccttcatcaatagaaaaatactgttcatgccaacgataaaggacagagcgctcatgcccaaagatgcaattaatgaacctagcttaacacctaatgccccgatcatctttgcagcttgaaagacca

SEQ ID NO: 6115 - DNA, 478 bp, Bacillus thuringiensis
atataaaatataaataaataaaaataaaaaataaaaatatcaaaaataatatttttatttaaaaaataataaaatataaatatatatataaaataaatataaaataataattaatataaatatatactataatatataataaatatatatacaaattaaataaaatattaaaaaaaacaaattaaataatatacataaaataataattataaaaataaatcaaacatactacaaaaaaaaattaataaataataaaataataaataatataatattaactaatatattaactaataatcaaatataaaatataaataaataataataaaaataatataataatatataataaataaaataataaaaatatataaaaccatataatacaaaaaaaataatatatacaaattatatataataataatacaacatatataatcaatattataaatataataaataataaatatatataaaa

SEQ ID NO: 6116 - DNA, 140 bp, Bacillus thuringiensis
atggaggcctaaacgaaaccattgcggtgacttatctagcaaggatcttgtcaacacccacacacgccatatattttggaaatggtatgaaaacgcctaatgatagtaggcacggtatataggtgctacatgacacacgc

SEQ ID NO: 6117 - DNA, 225 bp, Bacillus thuringiensis
cacgcacacagatgctcgacaccacacgagccggcagcatccaggggacagcctggggcgcatagtgagtgagctcactgacagtcatagagatgcgcacactggccgctctgcaggcagcaaacccgccgcgccagctgcaacaacgaaacagccaacacccgagaagaggcggcctgcgtattgtgagctgttacgcatcctacatcactggctcggtgctca

SEQ ID NO: 6118 - DNA, 300 bp, Bacillus thuringiensis
gggagaagcctaccccagggaggtggttcatcgagcgcatagacacagcctaaaccgggcaaccaggcgagcctcgagcgtgatagctgtgggtggctggcatcatactcgactaacgacacaagctactacaggtgtattgtgagctactgctcaggctacgaacagtatgaaaaccgcaagctcggcatcgctcttacgtacatctggcacagatcgaggatatgacgatatcactacacaatgacttgattgctaaaggactcgcaaaaaatggggctggtcactggtcctgacatg

SEQ ID NO: 6119 - DNA, 240 bp, Bacillus thuringiensis
tcgtaggtgctacgatcgaggggtgttttttaatgtgataatccagcgtttcaccgctgcttggttataggtgtaattgggagagcgtacttttgcaatcgtactcagatattcttctaatgcattacgagccgtttgtggggggtctcggtgattgtgttcaccaataaatccgtaaggttggactttccatggataaagggtcatcttactaacgtctcgttgaaagtcacctacaag

SEQ ID NO: 6120 - DNA, 361 bp, Bacillus thuringiensis
tgttgcgtctattttttcaaaagaggtagtgacaccaagaaaaacatttctttatgcgagtgaaacggttctcactctttatcagaagccgttggcccagcgttcatataagaatgggacaatatccgatcgactgcaattagacatcgggttagactctgaccgacgcgtatggttcgttaatacgtatgccgaaagcaagagcacatgatggtattggacaagaatgaatgtagctgatcagggctgaagaacgtatcaatactgagaacgatacataggatcctttgatgcctggaatggtgatggtacgattgttgacaaactagacaggctatagtgtgcacatgctacggaaaac

SEQ ID NO: 6121 - DNA, 141 bp, Bacillus thuringiensis
aaagaacgtgtttttcaccaacaccgggcgacgctccgtcggggctcgaatgatggagtcgtgccgtaacgcctttccatgacccgcaaatccgggtttttcatagagtgggtgatctaacgagccgtatcatgttctttg

SEQ ID NO: 6122 - DNA, 304 bp, Bacillus thuringiensis
taggaaaacagattttcgagtgtatcgccctagcggacggcgaggcgactctgggtgcgaatatcgctcttcacctgttatgtaatgacgaagccggttaatggggccgcactggcgctgatgcaagtctatcaaaagaaggacgcgacatccgactgatcgaggtgaaaacttgcgcttgcgaatgaagtgcaagtgctattgttggtatcgacgtgagtgacgaattacttatgtgggggtttgattttggacgcaggcagacggactgctggtcggatatatagtcaaaagccgagctggt

SEQ ID NO: 6123 - DNA, 402 bp, Bacillus thuringiensis
gaaacccaggctagagcaccccccaatggttttggctacaccatcatatcggggcggagtgcgaggacatttgagacagtatgtggatcgctggttacaaagcttgcgacctactttccattatttggtagaagacctgacgggcataaaaaagtatggtgtcatcgactgaggtgacacctcaacggtaaaagcaataccgattattgctccattccaacatatttgagactttgctggcactgcatgtgaaggttatgatatcgcaaacgcgaatggactggatgaaatttacaacgatgctgtggcgctgggctacgcacacttgtataacgattcattcgaatatagctaacagaaatccgtgggacactgtctctctgctgcgcatacaaataacgt

SEQ ID NO: 6124 - DNA, 372 bp, Bacillus thuringiensis
cgagtatgctactatatagctcgagtgctgtatcaagttctgggtggtatttaacacgaactgtcatggggacgtgctgtgttagaacctttgatcacggcaattgctgataaaataaaatgaaggaatgacggaaacgaaactccttgttgaagttctaaaggtatggcatggctgtagaacgattgggtgacctccagatagaagacttacttgatacaggatttgttaatcgcgcgggtgaccatatggcgacggaaaaaaaagcgaatccaagtatgaaagggacctatcatatgctactccccagtaaatggcctcaacaggacggccaatgggatggagatagcgacaaagatgtcattgttaccg

SEQ ID NO: 6125 - DNA, 144 bp, Bacillus thuringiensis
gagtatgagtattattcactgccgtatgggaataagcagggggggattgtttgaatagtatggcggtaccgcgaaaggttttacatatagataatggtgggatgtctccagtacatacgtctaacgacggaacagactatgttc

SEQ ID NO: 6126 - DNA, 371 bp, Bacillus thuringiensis
tcgcgatcgtgacaacagctgatccactgccgcgtctattggaagatgcgttctggatctatccagattatgacgagacgaatcagggaggatgaatgaacaaaacgaagaatttcgacaacatgttggccaagggataagtgcaagtctctacgctatagagaatgtcaacacacgaaggagaacgttactatatttaagcacgtgaaaagcgctgagggagcgtgtataatactagaacacatatattaagcttgggagagtgtgccgctggatccgttggatggtataaagccagactaaacgaattacccactagtatgagcagggaattgaacactgcaaatacgaggggagagctactaaactgt

SEQ ID NO: 6127 - DNA, 263 bp, Bacillus thuringiensis
ctgcctggtggagctgtcacaattagatcctggccgatcctttattcctgcgcggattttaaagcggatggcaaagacagggcgaccttcgagtgttacagaaatggcgatacaaacgatatagccagtttgtcgcttgtattgaacgtcagcatgtagtacgtcatactgcagagcacctttgacagattctgctggatgcagtttataaatcacatgctcctcatcaatggatgatgcgagatacgcagcttctactggtg

SEQ ID NO: 6128 - DNA, 373 bp, Bacillus thuringiensis
caatcgagcgttattaagcttatcacataatccaaacaccggggaacttcaaaatcgtatcgagggaataactgcaaatgtgaggtatatgagattcacctgcagtgggtcaaccagagcgctcaaggtaaaaacgaaaacgctagcgttgggacggaaacgaccgtctacaatggagagggagagataagataacgaaaacgctctctaatgcactgggggcctaagacgattcagatacatgagcatgactaactaaagactagagtacttgatacaaaaagccgtgaaacccagacggtgaaaaacaggtaatgcaaagaacccatgtgggatggcgcgccccaccaaatataaagagcctgtgaacctg

SEQ ID NO: 6129 - DNA, 541 bp, Bacillus thuringiensis
cattaatacagttttatctgtccgaaaaaaaacgtgtgatatggggattccgtcaaactggtcactgctctcacttgctacggatcagatgttacatatgtattaagcgccaattgttagcctagtacccacacatgatattggcaataagagtggcatacttacatctgactcctgttatgtcggaatatgaaatcatcgacatattctttgtgtgaggcaatcaatattgtcagacgacctgtttaaccagcttcttagataatcagcgtggatgacggcaactagtatgacctatcctacctgcctttaaatgcgacacgaccaattgagggtactttcatatgtttcagaccatgtaactactttactacggggacaatttttcatctacaaatatgatagcactaaatatatattggtcgagatatacactagactggctgtgcgtacttacacttatgatagcttgcatacatcgaattatacggcaacgaccgtctagaggaacacacgatagggcatctttgccgaaaggagc

SEQ ID NO: 6130 - DNA, 396 bp, Bacillus thuringiensis
caactgccgttgttattgctgaggctgcattaatcttactgctggatttctatatagttgtaaatgatgatcctgaaaatatgccgatatatatagacgtggatactgcgatcggactaatgcattcattagtgaggttgttcttagaaattcttcattacgtttcttactttaccaaaaaggactaataacaacatgctcaagtaacaatgcaggataattttatttttaaaacagtattgaatgtatggaataatatgggagatggctactcaaagtgattgatatggtttatgaagaaagagaccattgtgattatgaaaaaacgattggatactcgtttattcataggactagatgaagctttaacgtagaggaaataccatgttatgactt

SEQ ID NO: 6131 - DNA, 251 bp, Bacillus thuringiensis
tagtgcaatatccgggggatttgccttgagtcctggacctattgttgtcgatacgaacgagagttcatatgagtggtggccggactgttaacagcgctgtagataccgcgcacgcattatgcaatacagttgaaatgttggtccaaggtgaatccgacctgaataaagataatgtgggcgtgcgcttttaatagaaaggagaaaacctttggcttggtgtagataaggatgacgaaggacctttcattggc

SEQ ID NO: 6132 - DNA, 172 bp, Bacillus thuringiensis
ggacctaacggattattacagtatgaaacgatttctcataacttaataacggatatgcctgtacataatgagccgctattggccacgcaaaatatgatattaatagtagatggaacgtttttattgaaaaaagacgttgcgcatttatttgattacaaaatttttgtatata

SEQ ID NO: 6133 - DNA, 273 bp, Bacillus thuringiensis
tcttggcatcaccggtgctagccggtaaatggccatatacttgtaaatgacgcttaactgtgtctcgcgctgcatcactttgcattgagtgcacttcgtatagcaaggcgagttgggtattagaccttaaataattggttggctttgctatccctaacagcatggagacactatcatgccctttaaccatgacaatcaccaggcgcacaaaggagcacctcatggcatcacacgaacacattaccttttgcatttgcttgaaccctattaacg

SEQ ID NO: 6134 - DNA, 116 bp, Bacillus thuringiensis
gatgtaacaaagaagataggccgcagattaactgcccgatatgccttattggatcaactaataatcagcggaggggggatcccttcactgaccaaagcctcaccacacaggagagg

SEQ ID NO: 6135 - DNA, 238 bp, Bacillus thuringiensis
cgcaagcaaattttgttgcttctgcattacatggaaacggatctatatggggtgatatatagtttcctacactactcgacagagagttggtggttggaagatcaggttgtgtgaccaaactctgaacaactttaccgcgaacaggggtgagcacttcatgagtcactacttttacattgcgatctcggccccatactaaatagttgttgcatgatcgaccaaggcgaactgcggattg

SEQ ID NO: 6136 - DNA, 390 bp, Bacillus thuringiensis
gacgatcctctctctctctttctggaagaaaccaataaatagaaatgttcatggaaacttatattcaccgcgaataataatctggtcggaattttaacataaactatatcttaccgctctctgtcatgtattactgtgctgaaagacgaactatatgtcattgttgttcttcgatactatgaatacccctgggttggataaatctagggggtgtcctgtcatgcagtcttgaggaaatactggtcaagcacattgtacggggcgttctgggcttgcactggaaatgagacggaatgcaggagtggttgtatatgacacgtaagaggagtgtatagaagagcacctggctgttccaccactgcatgaatgctcgatagattgcgcacctac

SEQ ID NO: 6137 - DNA, 295 bp, Bacillus thuringiensis
ctctagctttctggcaacatttactagaccggatggcggtgagataacgtaggaggaccactgtgtgagccgagacataaccgctggatggcactgtcgcgtggaccatctggagcgcagaacttggatctggcgcaaccaatggagcactgcgaccataaggcaggacgtaccgtataggagtgatccacacataccggcgataggcgacaagggatgaactacagagacagaccgctgacataggaagcaaactgtacaagcattggaaacagcaccacccagtgtactcatg

SEQ ID NO: 6138 - DNA, 340 bp, Bacillus thuringiensis
gacgcgtttttgatgggaaaccccgaagtcgtgattggagagatggtccttgttgcgaccggaaacctcttatgacgatctgaaaggccgacatatacgggggacaaatcgctgatcatggcgattagacactcactaaaggatgcgcctggcacaatacaatggggtcttacatctgaagagcgctatgtctctcccatcgctggagtatgcgagtcagaggcagagcaaataagccgattatcagataacgctatgtgcaccccaatgcgaacagggctagatccattggtcgctaccgcagagactgcacgctaaatacttcaccaattgctctggc

SEQ ID NO: 6139 - DNA, 238 bp, Bacillus thuringiensis
atacgtgtgaggctagagctcgtcttttctttttttgattgatgcctaaatagcattgcaggcgttccaaaatgaacatgcaactggtagtatgtaacgcactctgatcagatcctaaaattaaaccaagcaccaagtgtcgttcttacatcgacagcggcattgtatacgctgaccgcatgtatctgacgacttgtaggagtgatgagatgggaatacaattgatttgagatatgaa

SEQ ID NO: 6140 - DNA, 394 bp, Bacillus thuringiensis
ggatgcagtttttgacgtcttataacaagaagttatgaaagaaaaagtgtatgaagaatccacaggtaactgagatagtacaaaaggctgctctaataatacaaactacacatattaatactgcagagattgaagtttggaaagacgggacaacaaacgtcacttgagcagcagacaagagcggttatgcgacttttatgacgatagaaccaggagaccacactgttaatgaaacgcatgcggcagtaggatctactggatccgataaggaaacgaaatttgcgacggctaatgaaaaacctgaagttgacaagattcaagttacaagtgaataagatgctgcaaaaggagcggaaaaaccaggcgacggatcagtgaaggcgggtgaaggaac

SEQ ID NO: 6141 - DNA, 182 bp, Bacillus thuringiensis
agaattttgttgtttgtacggttgtatttgttatagtaaaacacgtcgatgcccactgcactactgttgatggctaaatagttctaggtgccggataggccttcttcacggccgaaaccacttaatctgaatccaccaaatggtgcgtgggcaaccgagggcagagcgttgcttacaccgat

SEQ ID NO: 6142 - DNA, 125 bp, Bacillus thuringiensis
tcgtgatgttcttgaagagggggccttacgactgctccactagaagattattatttggtctctgcgctctgctagtgccggttccctttggaacaagagggggttgctgaagaaccggcaaacaa

SEQ ID NO: 6143 - DNA, 280 bp, Bacillus thuringiensis
cgttccgaggtgccatagttcgaagccatcacgacgaattcgagggtgattttttaagaacagctttctctatcacacatgtgcgctaagcgactcacgccaattctttacccgtatttgggaaatggtttgcgtataccacatttgggtggggaggatgaccgatatggggctgagatgcccactttggcgggcgatgctgctgatcctacccataaagttctcgcggcgggattataccactatcgctgagggctccaatgcgcgtcgatcgagtgtg

SEQ ID NO: 6144 - DNA, 412 bp, Bacillus thuringiensis
cctcgacgtcagttttttaaccgtctacatacgcctcaacattggtctttttcatagataatgtcgatgcttcaaaatgttgacctattgatgtactaccctctctgtgcgccggcccttgctgagagtgcgtctcatgcgctttaccgacactgtgagcaatactattcgtgtttacctctactgctgttgcacgtttatcaactgcactatgattatttactacatcagtcatggcttctttcattccattaacatttggctcaatctcagttgttcttgtcgtgaacgtctcttcagcaggtacttcattattagcaggtggtcatgctcttcttatgttcccctgttacattctcgcatgacgtgaggcaaaatcaccatctatacagcgtccagagtactgcaacct

SEQ ID NO: 6145 - DNA, 176 bp, Bacillus thuringiensis
tcggatacatctgttcatgactgttgatatacgaggcgactgataggaagctcagtgaagacaacattgccatagctggctctttacttagattgcacaacttaacctgcaatatccgcttgtatagagacgtattcttgaacagtaatacctctaccagaaggcatttgttacca

SEQ ID NO: 6146 - DNA, 190 bp, Bacillus thuringiensis
gcgaaatagcctagtggtgttttacagacaaacctgatgataacactctgatggaacaccggataggacatactactagtatctggaagaagattatgagccacaggactatgttacgtttggttaaagtttttacaactacgaaaggccaatgcctgataagcaatgaacggagaaaccaatgcgccaa

SEQ ID NO: 6147 - DNA, 504 bp, Bacillus thuringiensis
catagcgcgagattttttaacagtgctattgacgaggtggggagcatgctgaatattactgagggctgcgagaggtgcatgacgacctcatgcaattactgatatcattaaggtggcttacgggacaacagtgagagcgagatgatggactacgcactgatgaaaactagctgttaaaggaggtccagactgatactcattctggagggattgaacatgagcgcttagcgctccaggactggaatagacaagcgccatgctaaattgaagtaaatagggttttggacaatgatactacatgtaataaaaggagacaatgctcagaaaacaaagactacacatgagtggtaacttatgaatataagtggaggctgaactatacgatcaacataatacatgccaatcctctatgaattgaaaaggatttgagacagcatgtctggctatgcaagatcggtactgtgcacatgttgacagaggaaagtgacgaatgctataacggaa

SEQ ID NO: 6148 - DNA, 276 bp, Bacillus thuringiensis
aagtgggaacagtttatattagagtgaaagccgaagacgccatggggccgttttggagagcaaaggggtgcacctacactcataaaacatttagtaagtgcaaccacctcgggaatgtctgatcaagacattcagacagagacccaatggcaacgataataaaaaaaccatctaacccctgtaaaaggccgcccttttcaagatagagatattctctacgcaacgaccgaggctaacgatagaaatcctaggactagggtaaacacacatgatgac

SEQ ID NO: 6149 - DNA, 344 bp, Bacillus thuringiensis
  unsure (1)...(344): unsure at all n locations
tgtcaccaaaatttccgaagcgagaagcgcaaaatgtacggggggtgttttataaactaccggccgcggacccacgtacgcatccaacaaatacagctttgttactgactttgacgcccagcacaaagggcgaatacagtccgcattgacagtatcaataaaaatgacgcagggccagccctaccccgnatacgttgaaacatgggaacttcaacgcgcttcatacgaacagaaattaaagtactacgcagacggtaggggcctgagcattgaaggctaactgctagggccacacacaagacaaacgattaactgcagccatccgaaacaatagtgaaaaagta

SEQ ID NO: 6150 - DNA, 130 bp, Bacillus thuringiensis
cagacctggtgctaatatacctgcgccggcggcttctgctaagagtgggatttttaaggcaaccgaatgtgtcatcgcaaaaaggttcgtatggtcatttcatcgtgcccacccatctcttcttgttgaa

SEQ ID NO: 6151 - DNA, 356 bp, Bacillus thuringiensis
gcagcgcccaatgccggatcaagggtgatttttttaacagaagtctgagtttcgatagaggcgccagcagatgaccaagagtcggtaatctgacgagttcgaacaccgactactgctacaccaccagcgactggtagaacaggaatactctttagagccaacactgctgcttacgtttcctcaggggcataaccatgaattggtgattgaaggaacggacgagtattaacggcacaatttacatcacttgctgacggtaaatctactaagagctaaattgcagtgatttcacgatcctgagctttgcattaagccgccagcacgactgatgaacgccgtatgagacatgttaagcc

SEQ ID NO: 6152 - DNA, 308 bp, Bacillus thuringiensis
tatcttattattatcaatgatacaaatttcaagaaaagactgatcaatttcaaaacaataagtccttaaaatctacggctttaatatgaaaagattctaattctttggcttatatagggacatctaatattcgattggttgtaagaggcaggtcgtctatgtcagctctgtattaatttaatctgttttcaacctattttcaataatgtctataggaggcgcttcttctgaattatctactacaataccatatatatgaatcgacccagtgaccttagctggttaacaatggggaaatcgatatgaag

SEQ ID NO: 6153 - DNA, 121 bp, Bacillus thuringiensis
tatgaggcacagagtctttctccgatacgtatcgatcaaaattattgggtggtactaccgtctatctatagtgaggggcttcaacaatatgagtcaagctggccataactggatgcgaaga

SEQ ID NO: 6154 - DNA, 309 bp, Bacillus thuringiensis
aacagtgcggaagattcatacgaaacaacgccggctacccgcattattgcaatctatgagactctgatccaagccgaacgccgactgggaacacttccaccaacacttttactgtctggaggtgcacctactgacggtgtagtcactgggcaaccagcagctcggccggagactcacgtgcctgttgaacataaaccacctccgcaaaagcctgctgtagaggatcacgaccctttatcgccaaaacccgctgaaaagaagaatactcataggcctgccttacagattccccctgagcaaaaccctgct

SEQ ID NO: 6155 - DNA, 168 bp, Bacillus thuringiensis
gcccagcatactcaatggcaccttatcggtactgaaactttttcttacgtgctgccgcactggcagtagggggggtgcaagcaaggctcacacatcagcgatacaatgcatgtcgccaggacatcctacagccagcaaatcgtgtggggtaagaagctgatcatcata

SEQ ID NO: 6156 - DNA, 168 bp, Bacillus thuringiensis
ttcgtgatggagagaacgttcaaccctccacaccatagcccacaaaaaatgctcgctcaccaatgaactccacaaccacttggaggagcacattatcacctacccattccgtacaaaacaagtttcttctattaatcatgctcctatgtctaaaaaaacccttacatt

SEQ ID NO: 6157 - DNA, 107 bp, Bacillus thuringiensis
acaagaattgactgtactagctaacttacccgacaggagctccgcatgcaagaatcagacaacaggcggagacgaggccgccagcaattagattgcatatagcttaa

SEQ ID NO: 6158 - DNA, 273 bp, Bacillus thuringiensis
gatgtacaagcattaatgaacagctatgaagtggagtatgtgctaccaggttatttgatcccgcattcaggctacgcataaaatggtaagaaagctgtaaacaagtaaaaaggtttaaaattaccccacgggatgagggaattttttataattaggagaacaatactctgaagattcaagcctcaaagaaaaacgaggggacccaggaatcttgggagcaagaaaaatggtaaaacaatttgaagaagccgcggaaaagttgaaaaaaggtga

SEQ ID NO: 6159 - DNA, 119 bp, Bacillus thuringiensis
cctttaataatagaagtattaatacacgaatatgcgccccttatgtttacccggagaagggaaacgccttaaaaggagggcgaacgtaacaagaggaccccttgaaaaaaaactgccac

SEQ ID NO: 6160 - DNA, 266 bp, Bacillus thuringiensis
gatccatacttcgtgatagataaggaatgctgtcactgggctacgtaaatgaaagatgcatgtacccgagaatggatacagattgactgaacccgtacactacgtaagggcagaaccgaaatctgcacccataaatacgcagacttaccttcacttgaccgatactgaagaagttaaagagtcaagcccaaccttgtaatcgcaaccaaaactctgtactgtaatgtgagaccccacgtacccagtatggcagcattaaagaggtt

SEQ ID NO: 6161 - DNA, 254 bp, Bacillus thuringiensis
ctcgtcgattttggcttggctgacccactgcatgggtacatgcgaattctttttagtagggctgaacctgcgtaaactaatgaggacatacttgcgccctcaatgcggggaaacccagctgtcttcgcaacgacaccatgtgctataccgctgctctagtggccgggtacagttggtctacattctagtacccgttgctgaacagtatcgacactctgcaaggcttcatgtgcctgttgtttactcacatctat

SEQ ID NO: 6162 - DNA, 302 bp, Bacillus thuringiensis
cgatcagacttcgtgatgagctcgcggtgcttacattgatgcctgcacctacaaaagacttctgactttagaagatcttgatatgtagcagcatccacaaatacgacctacacatatctgactcaatcatatactacatcaaatgatgggcatatgcctagcatgatatttacatttcgtatactccataaaagaaatgtacctgactcaatacgagccacgagactagggattatgacctacatatagctccaactcagatagttcatcaccatctgtataccagattgcctatgagccat

SEQ ID NO: 6163 - DNA, 255 bp, Bacillus thuringiensis
tttttccccacatgaagaaaccccgctggggggttatctacagacataaagacgataatcccaacaatgaccatgaaagcgctcctaactgcatcaaagatttttcaaccataatactatccattctcctcttatatacatacatgtgaaatctatctatctaataaattcacaaagactgatttgcttttagaacaatttaaaagttcctatgaactaattatctgaacttttgtctaaatatgcaagtattat

SEQ ID NO: 6164 - DNA, 261 bp, Bacillus thuringiensis
tgatgaaactagatcacgaaaagcagcttggaaaaaaccaattgataatttggcatactgctcgacaggcgctaggggggggaatactgggcacgaccactagtaaccacgaacagagaagacacaccagcctacgttagctgcacgtacgtagtcactgcatactaacattgcatcaccaacacctgcatgagcagatgcaatacgcgaaggcaacacacctcttaatacaccaggggaatcagcataaatggacataaa

SEQ ID NO: 6165 - DNA, 279 bp, Bacillus thuringiensis
tcgatccgacttcggatccgcgcgatgggagttagcgcaccataagaaagtataactagtgctgtctgctcagtagtctaatgctgggcgcatttctatttaacaatataaaggaaatcacaaccacgagattcgagaatatggaaccccagatcattacatatgcaactcaccccatgaggaaagcatactctaaaggagatgttgatgttaagagatgaactagatgaggccaccattctaactcaagacttaataagacccagatcaactgcctct

SEQ ID NO: 6166 - DNA, 135 bp, Bacillus thuringiensis
aggaaggctgtgtgctagtcatacaggcagtgacgcaaagaatggagggtgaaggtattctatcattcttcccacaatgaagaactcaggaaatgatatgcgcttgccagtgctaatgaccggtgcaggagggca

SEQ ID NO: 6167 - DNA, 188 bp, Bacillus thuringiensis
aatttgagcacgatttaataatagacgaagcagacaaaaacccacacgggggacttttaacagctattacgcgcgaacacccaaacaacgcatataaacattattcaatctgaatcaaggacaatcaaaacagaccaataaacctaaagcaagctaacactcatcttcaatgggtggaacgaaaacct

SEQ ID NO: 6168 - DNA, 125 bp, Bacillus thuringiensis
gtagttcgtatctatatgtgtttacttatgcaacaggtgctccgcatccaatatccagatatgtggattacactgcttcgccatctgctaagttccatatagcttattgtaagtacgctacttta

SEQ ID NO: 6169 - DNA, 207 bp, Bacillus thuringiensis
ctacttggacagcataaattgaagaaaggttaatagataaatagctaaggagtgcgtatactgcaaaatacccaaaagacataaaaaatgaagaaataagcatgaaacgtatcggtgttgagaaacttttcatagaaatcctcctaattatgtattcagaatataatatattgatggttaactaccttataatacattaattcatat

SEQ ID NO: 6170 - DNA, 105 bp, Bacillus thuringiensis
acttaatgcacatactcgttacttaataccacaaatcctcttactcaagaggggggccccttcaaaacgtaacaccccataagatccatctccagacttaataag

SEQ ID NO: 6171 - DNA, 392 bp, Bacillus thuringiensis
  unsure (1)...(392): unsure at all n locations
cgtgattagcgtcacaagatacttataacaattactgctacaattggtantgaacagggacatatcgaattactaggggtgggtgatttaaacactcagccaatacttgccaaaacgaaatcttatttacagtatcaagatggcatagtacttaaatcagatttaataacaaacattgaccgttaaacctttatcgaacatttacgtccatgctcgtcataattcgacgcactaacgggtcctgaacactattattttaaccaaaaacccattatattttcaatggaagagagcctttacgataatgctgcccgctctaataaacattgtttaacataaggtcggcgtggcactttctaaagaggatgacgtctattggactactcttgaag

SEQ ID NO: 6172 - DNA, 229 bp, Bacillus thuringiensis
actttcaacatttcttattcatgctcgtggtgcaacgtgtgaacttatggtaatacttaggccaagagccgctaaatggtccatcttaacgagtggcgtcacatccgaaaatccactgccacgcatagctaaatgactcactcgctttaagtgcgcaaagaaccgccgggcttttaatcctcccttcccaactgtctaagattctcaatctggcacactctttaatgca

SEQ ID NO: 6173 - DNA, 334 bp, Bacillus thuringiensis
ttcggctaatcgaacactcatctctatttagggatccagatcatatcgcgtctttaatatactcagaaccgaactttccctatgctgaaacaaatattaactcgaaatgagcagtaacatatgtgtcattcattgaatactaagatccgattacaaatacacacaacatccaaccctgaaacgaatattttaaaggcatacgttcctactgatacagctatctatgataaaaaacattgcgcacactattatctttacattgctgatacattacataccacctgagaccatatatcgagaatcccacattcagaggcagtgtgcgtagtgaact

SEQ ID NO: 6174 - DNA, 116 bp, Bacillus thuringiensis
gactaggtggaatgtctcgtttatgggctacaaaaagactaggaggctggatacctgacgccaacagatgttcgctacactgccgtgatatcattctggcctatgatttttttgtt

SEQ ID NO: 6175 - DNA, 237 bp, Bacillus thuringiensis
gtgcacaacatttttaaatcggtgactaacagaaactctctatttgctttcctccccatcttctgctagcggagagacacaatgacaccccatgtgaacgctccagcaaatactgcatcaccctatataacggaatacgcaactactaatcccagtcaatatcctgaagatgcagcaattacaaatccctctactaacacgtcctctataactgaacaagcacaaacgtacctaaca

SEQ ID NO: 6176 - DNA, 123 bp, Bacillus thuringiensis
tactcagcctttttttttctaacgacacaaccaactaccagggggggggtcattttaaaagacggttggctaccccaaacacccgacaaaccaacaaccattaacgccccaccccaccctcca

SEQ ID NO: 6177 - DNA, 225 bp, Bacillus thuringiensis
acatcagagcacattttcctcttatgcccagaatccgtcaaaagggcgaggtgctgattcaggcccagagtgcttccacccccccaccaccataacaaacaccgacccaggtgcaccttccctaattacctcacacccaccctacctcaaataccatcatatcccaccttcccctcctcttcacttcctttctcacactctttccatacccgctccctcttcccc

SEQ ID NO: 6178 - DNA, 232 bp, Bacillus thuringiensis
aaaagagtccatacattcacaaacatatttgccctttattctgttatgaaaaaacacaaaaccaagctctgggggcgcttgtaaacacagctatgtgcgcaccgcggactaaacaacgcctagtgggaatgacactcctgcgaatacaagtgcaaaagaagcttgaatggtgcaaaccacaaatctaccatagcgtgcccgggccaaaggaagtagctgcgccactactacc

SEQ ID NO: 6179 - DNA, 232 bp, Bacillus thuringiensis
gtggatacaattaccttctaccgcacgttacattacacgaacaggtgaagggacttgacttgaatgttgtgagggagatagcagggtcacctgctgatgcattcggatttacacttgacttgggactttctatcgttcacccaggtgctgttgagccacatgcgttctctgttgttacatcgtacgatattgtggggcaaatatcagagggagagagagatactatgactga

SEQ ID NO: 6180 - DNA, 446 bp, Bacillus thuringiensis
ctaactcctgcgtcgtatatttatcaacggggctgcgcagtttctatggatcctgcgctaacaaattgactaggatctgctgagctgccttcactacagaaacatctaattctggcactaacacttaaattctatagctctggatctgtagccgacccatttatcaacatctgctaaatcgatatatgctgcagctccatttgatttagcggaatagctgttagtgcgtttcccatgactagtatgccctttacactcacacattactctgagtaatacacgcgatatactgttagaccctatcattcattctcactggcaaggtagcaggggtccctatagttgtacggacttcctaccatgctgacgatccacctcgtatagccaaggtaaaattacaatgatcttgtactagtgcgactgtgtttaatggacgacataaccct

SEQ ID NO: 6181 - DNA, 237 bp, Bacillus thuringiensis
ttaaatgataacatcctaacacgcaaactatgtccttttttttatattcttaaaatcatgtatgcctcttactcttgacaaaaatcttcaactcaatcttttgattaaaggctctctatataaatatacttttaaaacctgttcattttcccaaactgaaataatactacttttttccccttttttaaccattaactcgtttacctaccacactttacatctgcggaaatgctttta

SEQ ID NO: 6182 - DNA, 136 bp, Bacillus thuringiensis
tcgagatcgtatgagcttttgcaacgccttcacttgtcagaatctttttcttattatagcacgcagccccccagacacgggccgtgtaccatttctgatgcgcgctctcgcacaagatgccagcttttgcggctcc

SEQ ID NO: 6183 - DNA, 370 bp, Bacillus thuringiensis
  unsure (1)...(370): unsure at all n locations
aatncaccctttttatactctaccacatcactattatataacagagatctgtagtctttaattccactttcaaatatattttcacaaacccacatcatgtaaccacaaataaatttttaaatatctcattaacttctaaaattccaaaagacttacataaataactacaaactactttataaattttaacactttcatttatattcactacttcatgttaactcttacttaaccttatccacatatcattttcaaatgtatccaaatattttatcctgtaatattacgcacataaaactataatcatattgcaaacttctccttcatatgcaatgcgaacaaaatcaaatccacctttccttatcatttt

SEQ ID NO: 6184 - DNA, 150 bp, Bacillus thuringiensis
tagaaccccaagctttcttttttacgctctgaaccctaaaccctgaggcgtatttcttaaaccataagtgccaatctttaaaacctaaatcctacactcggcatcccgaatcccaatgctcatcaagtatcaatgctcattcacacacaa

SEQ ID NO: 6185 - DNA, 102 bp, Bacillus thuringiensis
gatatgattcgaaacacattcaaatatgtcttcgctcaaaacatacttttcttcttctgtttcaacagctggttatccctggtctttagaaaataaattaca

SEQ ID NO: 6186 - DNA, 101 bp, Bacillus thuringiensis
ggagttgcaccacttgctaaaatgtttgtattaaaagcttctgtgttttgatggttctggaagccatgaccaaggggtggatgccatacattatgccctta

SEQ ID NO: 6187 - DNA, 389 bp, Bacillus thuringiensis
gcctgatgctgaattggcacattgcgcaacgacacactgttttttttctatgtctaccaaaaacagaggacttgcgagtgggtgtacagggtgaggaatgttttacattggcaaggcttaaagaaagacatggatggcgacaatcacattgcgatgggatgtataatgatgcacatctacgtgctgtacatgattacacactaatgtgtagtgtgatatctactagtatgcaatggagggaatttactaatatggaacctagttctgcggtttaaagacttcacctaccacttaacatcaccttctctgtcattaacagacgacaaatctgtgatttaactactcttcacgtgaaattaggctatgataattgcgtacctatacgaagg

SEQ ID NO: 6188 - DNA, 308 bp, Bacillus thuringiensis
ctaaaaaaaaaccttaacctcctttattcacctttaagttgttccctaaataaaacttacattccacccctctaaaaaattttttttttcccctttttaatttacccctttttaccccttaaataaccttttttagtaccccattttttgttccattatttaacataataaattattttaaccaattttcaaaattttttattcccaccttaaatattttaaccattttttaaatatattcatttttccaccaatattaaccccatttaaaagaaactaccttttttttaaccactttttcaattttt

SEQ ID NO: 6189 - DNA, 456 bp, Bacillus thuringiensis
aatactacacttatacatcttttcccacaaaaccttcacatatagctatttggaccactttatcctataaccactcttaccttcaatcaatatctattatttcatccaatctaaaatactccttacccaattcatatatcaattccaaaaactaactaccaatttatatcaaaccattcacctaaaacaaagccagatttccaatcaattaaagagtatatccaataaagatcttttttacacaaaatcctaccttgaaactttaacattaaacttgttagaagcaaatccaaaaaatggtttattactcctactaagtattttattcccgaattccaattcttttacattcactgctatatttatttatttccgattatatacaaatttgaatagccatcatcaacaatatataaaaatttccaaaattgtattaacctaacgctacttaaaaaa

SEQ ID NO: 6190 - DNA, 158 bp, Bacillus thuringiensis
tcaaaccacttgaatttttcacgcacaaaacccgacacacggggggggataaaatatcatacagagtcgcgataattcctccacctcactaaaaaaaaaaccggacatacatacccatttcttccttaagatcccgcccagccctacaaaaataccaa

SEQ ID NO: 6191 - DNA, 211 bp, Bacillus thuringiensis
ttctgagtggcatttgttctgttatgcacggaatcattcgtatgatcaagaaatatattgatggctttaatgcaccagcaggattgctaaactatacaccaggagtttgcgcgccttttttataacatgtaccaatgttttttaaaggcatgtccccgataggaagaccccttattccttattgtttaaaaaagtccctgggcctgtttac

SEQ ID NO: 6192 - DNA, 181 bp, Bacillus thuringiensis
tggaaaggcgagtgtgtcttttgatgccgctaaacccaacaaatggcggggtgcttacggatcgccattcggccccaccaggcaggcatctagctataccagaggtctgggcaccaccttcattagatctgacaaccccatggggagtcctgtatgttccacgtacaatagcaaggtcaaa

SEQ ID NO: 6193 - DNA, 127 bp, Bacillus thuringiensis
tgctgagagagctttttctaatgagtgagcgaacccacagtgagggctagatactaactgaccgcatatcagccaaaaaacacggcgggccagctacatagggggcacgggcaacgcccggacagag

SEQ ID NO: 6194 - DNA, 267 bp, Bacillus thuringiensis
ccaggctcgaaagctggtcacaaatcccattctcactctttcagagccactactctctgggtaattgagcagtttattcctttttacctctataaacccttaatgcttccatttttatttataatccatttccaactctacaatgttcggtggatttctttctttctactaggctaataacgcctctaccacagaagattcaatcccctcacactcacaacaagcctttaccactttaatacataatttttttccactggcaaaaac

SEQ ID NO: 6195 - DNA, 110 bp, Bacillus thuringiensis
tgcaaagtcttttatgtctaaccagtgaccacactcacagggagggggacattcaaactgacggttggacactctaaaaaccctacaatccatatgcacttatgcccctt

SEQ ID NO: 6196 - DNA, 163 bp, Bacillus thuringiensis
ctgcattggcatagctttctgtaccacgcatcctgccaatactcatccgaagtctctgttggggaggcaaggggtacggccctcaatggattctagcactgaaaaagcggcggaaaactgcacagtaccagctggaggatcatcagctgtataccgacctgag

SEQ ID NO: 6197 - DNA, 241 bp, Bacillus thuringiensis
gttcagcgttttcctttttgcagaaagctaggcagcctgtccccccagctcgttctattagtctggcaacgcgcggagagaggcatcatgttgacttagggcctatccatgcttcaagtaaaagagtctcacttagccgttgttgcgtatgctcagcaggttctatagttcccatatccgtgcctactgcaactcgctgttctacattctgaacacggcaagcgacgtggcgctcatgatt

SEQ ID NO: 6198 - DNA, 410 bp, Bacillus thuringiensis
taccctacggattgggatgttcatactgaccgactaggggggatctataccaacgtcaccaaagttacatccactgacgtagcttttttccagtcaaagcaattcgatcgtgccaaactcacatctggcttcagcgatgctgatataaaggttgctggctttatagaacgcccaaccgttagcctacaatttttacgtgcgaatctacaccacccagtgccccataacgttgctgcactcccagcaactgaccgaacaatgcatagtctgtcctttgcgagtacgctattacatgatggacctacaccgacatttcgtctcgttccagcaatctttgcagctggtcctggacgaaacgactttcgttctgcgcctggccacttaacacatgttgcttcggcatctgcaca

SEQ ID NO: 6199 - DNA, 205 bp, Bacillus thuringiensis
ctctactactgtatgcggatcaacaaagacaaggccccagccctcaatatctagtttcatagacaccacttactagatcattgagctgttgactacgaggttgtggctctaagatcactgaaaaaccgtttacgtcctataatatgtcaccacccacatctccaccagactcagtagctaaccccttgacacatgatgctggttc

SEQ ID NO: 6200 - DNA, 180 bp, Bacillus thuringiensis
caccgatgatctctagatcagtaccatataagtatccccagctcgagtgcaacaaatctcatgaagcgatattatagccccctgaggacgtcacatggcgcaagaaaacgtgcaacggagtgtatatcacacgcacctttgacaccactaagccacgcggactattgtttgcatgctcta

SEQ ID NO: 6201 - DNA, 301 bp, Bacillus thuringiensis
cagtgggcgaccggggcgaacaattgttggttcaaatatgatcacgttactttttataaggcgcatacaacctttcggggactaggtactctttcatgaggtgaaccttccacacgaaacggatcggcttctcttctcgcctactttgatctactgcgggtactacatcgtctttcttaatgtgtgaacgaagtattctaatttccgcaccgtcattgataacgaacttatacgcctccatattatgcaattgatgatgccattctcatctagattaattcattatgctaagtcctgaaat

SEQ ID NO: 6202 - DNA, 146 bp, Bacillus thuringiensis
gcgacttatgcggtactgacattaccgctagtggtaacatttttgccaacccactctcagcttcgatccgagcacccgacgtgcacgctctactatcgattgctgcagacaagagtgccgcgcgcctaatactagtagtaccacca

SEQ ID NO: 6203 - DNA, 132 bp, Bacillus thuringiensis
gcgaattattcgctactgtcataaccacgagagctttcattggggccaactcactcttggcatcgatgggagcaccgtacgagctcaccttattaaatattagtgcattcacgagcgctgctcacttaatcc

SEQ ID NO: 6204 - DNA, 291 bp, Bacillus thuringiensis
gccaacagtttctacctgttcaccagactcaaaaacacctactgatccatcgggagattcagttgcacctggagcatcagacccgacgcttacttctggtctaaccgttaccacaagaataacctattcaacaggtccaactggatcgtctttgtcgacatttttaacggacacaacgaagccatcggtttcaacatgttcaaccattccaactggaccaagcatttgaagatgttcttcaggagccactggtccttcagagtcaaatagtgcctcctaaccaacgcgggc

SEQ ID NO: 6205 - DNA, 455 bp, Bacillus thuringiensis
gggcggagaggctggccgccaaattaaattttaaaggggttgaattttggcgtgggccccaatttgggtttgggattcaaggggaatgggggcaccattttcctacccaattttctttttttccacggccgaaaaaacctccttggggggaaaggaaggtttgaagcttcccggaaattgggggtcccggggtttacccggttggtggggtttaataacccatttttcggggttaaaaccccaaccctcttcctttttttggggggcggcgcccattaatttttgcagggttcctcccacagggcccccctgttattggacccccttccccgggtctggcgggtttaatttttaaaaaccctccttcccctggggcgcaccctttaattcttccggggttggtcgcacagggtaatttggaagtttaactatggcggccggttagggttttaaat

SEQ ID NO: 6206 - DNA, 250 bp, Bacillus thuringiensis
  unsure (1)...(250): unsure at all n locations
tttttacccncaaataaaggtgatctgtccttaccggcctgaggcggtactagcgactgtcagattgaccgtgaatttaacgagatacacactgttctttcaaagacatctacgggtgctttgagggagataaaaccaccggcagtatgcaacgtcccgatggatacctaaggggtgaatcttgcaggagcgccctattgacgctcgattgattagtaggtttattgggaaacagtccgggatgcttcat

SEQ ID NO: 6207 - DNA, 230 bp, Bacillus thuringiensis
aaaatcatttttttttacagagggccggtttggctgaaaacctatttgaaattggcgggctcgcaactggagagtcaacgggggaagtagggactctttccgaaaggttatgacgttcagatgaggcacttcaatctttaacacagcaactagataatttggatggacctacatcacgagtattctatggagaacatattacgtcactaggtacaactaatatctttgta

SEQ ID NO: 6208 - DNA, 381 bp, Bacillus thuringiensis
caggggtttatttattgtgggatcggctacattagcagcctcttttgttgcaggtgggctcggttagctcatactattaggaatagatcgaaatgatcatgctctgattattctaggggccgctccagccgggttactcgctttatgctttgatataggacttggcatacttgtgcgaccgaaacgctcttctacgcgtgttctatcgacgatatgtcttgtttgtttaatgattgcttctgcattgctttggaggacagcaaactaagatattgtgcttgcgggcaaacgtggatcagaacctgaaattttaagtcacatgtataggctgattgttgaacacgatgcacatgtacacgtacaatgagaaccaggccttgg

SEQ ID NO: 6209 - DNA, 319 bp, Bacillus thuringiensis
ccaacgaatacagagcaatctttgtttataatgtgcacaaaggttagatccagctcttttggtagcacgagacccacaggctggagacataaagggttggtttgatagtactttcaagatgagcagttataataaaaaatacaaaggtcttataggaagactcacattatcggatgaactatctgtacaacgtgaacctaggacccatatgaaatggtctttaacgatagggttaatacatttgttcaaagcatctggccagagggggccacgatatttgcgaggaatagtatgccaatttgcgatacaaaaagagtct

SEQ ID NO: 6210 - DNA, 105 bp, Bacillus thuringiensis
tacatgaaaaaaactttcgtctgcggcccaaccgcaaatagatccggtgcttttttctgaaactgcacttgcaatccctttctcaaatggagcaatgtcttgagc

SEQ ID NO: 6211 - DNA, 204 bp, Bacillus thuringiensis
agataggatagatcggggtcctttttttgggaccatcttctccactacccgcgaacgtttacctaaatgaagcggataggacatctgataccatacgcactctaaacaaatgatggcaagtacgaatctgtggactatcaccgatcagcccacgatacatatttcgctgtaagcggacactccataaaaagtggtggggctgaa

SEQ ID NO: 6212 - DNA, 362 bp, Bacillus thuringiensis
tgatcaataactggtacaaaaaatgaaccacgtttactcgttttaatagcgataacaaccttcttcgaactagggggtctttttatatgttgaaagcgttcacacgaaacggaacgcgctttcatctcgcattacttgattaacaacgtcattctacacttgttctcttcattactctcgtgtaacgcaagctaatttattatcccgcaccatctgctaaaaccaacttattagcctccatattttgaacacgatgtagcaccatcatatgagagtccactcgctaatcccgaaacagcaagaaccaaaaatgatatctaacaccctattcagtccgattaattccgtaccttaatattgat

SEQ ID NO: 6213 - DNA, 109 bp, Bacillus thuringiensis
ataaatgtatgccattttttttttctactacactattaaggcacaatccctctactattatatatccatcacttacacacccctattaggttgctaaattatataccta

SEQ ID NO: 6214 - DNA, 256 bp, Bacillus thuringiensis
atgcttctaccggttttttttttgccacaaataaatcagatcatccagtgatggtacacggagaatttccaaacggtcaagtgcgacttgcaggttgacagagactcctttttcccatgttcgctagtctaaagattgacccaatagatggacctcacgtactggatgctacataccctgaaagaaggctatctaccctgcgaccacaataaatcctgtgccaggtaaatgatgcatcagttgaaagcgatgtgaa

SEQ ID NO: 6215 - DNA, 302 bp, Bacillus thuringiensis
aataccgttccatctgcaaaatgaaactgtccaaaggcaccattttctttcacacctgttacgagcaaagcagctggcgcatataagaattatctaaaagcaatacattgctgcgccatatggaaagggggtactaccaggagtagctgtctcttttgcacaagatgccaggtcgaacgcatattaatgtaggtgaaacaatctcacctcttcatgtatagcgcgcttcaaaatagcttttgacatgcccgtggaccacactatttaatgccagaaacacatatgtaccgtagtcccaaaaa

SEQ ID NO: 6216 - DNA, 362 bp, Bacillus thuringiensis
gtgtataggccctttctcttagagttacaaataatggatcacgtgccatacttatgtcctactattgtgttaatggatgatatgatgagcaaacaaatagggaggacctattattaaagaggcacggtgtgatgtttcatgttcgaatagattcatatacaagatactgcttgtgagaattggtatatatatattcgggtttagcgagtgaaaatccttcgtgggtatagatgagggcaggtggttaatgaaaaagcacatggagttatctacttgtatagggtaagagttcattcacacgcatcataaaattattctttccataaaatagtaaaattatttgggaggtcgtattatgaaaa

SEQ ID NO: 6217 - DNA, 146 bp, Bacillus thuringiensis
ccgaattatgtgatactgtcataatcactagaggttatattggggccaactcacttttagcaacgatgggagcacctgacgggcacgccttatcatctattgatgcatacacgagtgctgctcacctaatactagctggaccacca

SEQ ID NO: 6218 - DNA, 290 bp, Bacillus thuringiensis
tcgagataccccttttatttacaacccggcgaagccccaataggaggggccactatactaagtgaaatggggtatctacaccggttggacaaaccaaacaaacttggccctttagcaggcatagatcgcccctgtggcccaatttggacaatctgaatcagcaggctggtccatatctaagcgaggctcctctcattgacgcacagcctaagacgaagcccgctgtaacagcccaaaaacaggaccctgacttgaaagctcctaatgagaagaaaccacctcatggaaag

SEQ ID NO: 6219 - DNA, 331 bp, Bacillus thuringiensis
catatgccaggccttttactttggcatacatacacatatggggaatataaaacagagctggcctacaactatgtacatgcagcactaatggacaacctacactcgccggacagacacaatgtatgtgcaagacacagaaaccagccccccgccctgaactgcacagccgacggctattcctaacgtactgctcaacaataataataaaccaaagatgatgggaacaagagcttgttcaatttgactcacccaccttatccgatcacactaacaggagtagacgcagcaagcgctgcacattgattcacatacattcaacccagaaacaagc

SEQ ID NO: 6220 - DNA, 447 bp, Bacillus thuringiensis
ctaaaccaatctgcatatccttgcgcttgtacaaaggttgcattaagtgcttaaaagactggataaactgtataaaccgataaaggaaggaacggaagagacaaaatctacttataatggataattatgagctcgtttactacacctaatcgcgcagcagtggaatttttttatatgaatccgtctctgtatctagaataacgaacataatgtctgaattcataggttgtgaatccggacagaccgatcttgatcacgaatacacacagtttgtagctgccacaggtgccccattggaccattcctgatgtttaccgaattcaaatatgtctttcttcctatgataaaggttgtgcacatttatatgaaacgcaggcagtctctattgggcgttgccaatacgatataaaccttgcattgtgtgattaacgccgcagaagatgaaaa

SEQ ID NO: 6221 - DNA, 192 bp, Bacillus thuringiensis
cccgtaccaagatttttttcttggcggcgccagagaatggccccccttcgtgacaagcgacaccagacgcgtcgctcacgcgagaggaggcgaaccccggcaggcctttctagaaccaggtggccaccaatgaaggtacctccctgggctctcctgcagcgaccctggacctgacacgaaaccacgcccacc

SEQ ID NO: 6222 - DNA, 344 bp, Bacillus thuringiensis
cgacatgaatttgtttctgaaaaacccatccaagaaaagggaggaaaattctttggaaaaacaaaatcatcccacacctatctggtttgacagcaataatcggcgggttctctctaaaccacgaaaactgccatctaccatgaatgctgaataaaacagaaggagagacttctataatgaaagcctctccgtcttacaaactataatactcaccctgcttttgaaccatatgcaaatgcactacaaaatccatcattgacgatgaaggaccaagctgacgaatcattcgctggtacaacccccctaggacccggaccccggatcacccacatgtccctcctaca

SEQ ID NO: 6223 - DNA, 128 bp, Bacillus thuringiensis
tcgtgattcttctaaaatagactctcaatgaattatgggaccttcaacctgctcttccagcagcagataaaacccttgatggggggcctttcctccaattaacgccgggatctccccattctgcactg

SEQ ID NO: 6224 - DNA, 296 bp, Bacillus thuringiensis
atcgggtgagagtgtggcaccaaccaggaacaagactacactttttgttaccgatgactactcctaacactgggcctttttcttttatcctgttactaggtgagtctatacaggatatactaccttaagacttgccacaaccttcatcggctattctgcttaacatgaatttacacctcgatggatatcgagggatgacacggctgccgccattatgatttacgataataaggcatacattcacctgcggatagacgctcgtttcaaccgactaccatcacattcgatggcttacc

SEQ ID NO: 6225 - DNA, 270 bp, Bacillus thuringiensis
cgaaccaaacaccacgtatatatagcggaagaatcactgactaccatctggtgtgcgataaggataaatatacaaactaaaccctcatcccatataagagcaatcctgacgtatcatcgacgaatgcacatgaaccatgcgacgaacaggcacgatcggcaacattgaccacccgtctatacggaggcccgtggtagtgcacccactgctagagtggagaatcaataccgatatgacgtacacagcggacagcgttcatacatccaaggc

SEQ ID NO: 6226 - DNA, 305 bp, Bacillus thuringiensis
gtcgctggatatagcacggatagatggtaccagatcattttttttgcctcatagacaacaacaaagctcttgcgcttattgcccagaatgatccgcattgtaaacctgatcaaaaaacaggtacgatgggcaatggatatgaccattcaccctgcatacaaatggctgttgtatgatagtggggcaatgacgaatacatagtataaatatccacgtatgaaatatgacgcgtcaaccaaaagactggggcaggctcatatgtgaaacgttttcacccgatccccataagaacagctcgtgcggtt

SEQ ID NO: 6227 - DNA, 107 bp, Bacillus thuringiensis
atattttaaaacgcttccatactactattaaccaggacctatatcacacaccggggggggatcacagagcatctcgccccctcaatcattaataactatacatgata

SEQ ID NO: 6228 - DNA, 251 bp, Bacillus thuringiensis
aattaaatcataattacacgctttttcctaacacactcgaaacttggtttatttgcagttttttacgggccacccccattcccccgagttacattaaccctgttgtggacaataaaagaacgcaactatttctcatctatgtatgaccaattaatttagctctacctgttactataattaatacgccctgtagaacatcttaattgatgatataataaagctaattttaataaactttattgcgactgaat

SEQ ID NO: 6229 - DNA, 131 bp, Bacillus thuringiensis
gagaattatgcgctactgccataaccacgagtgctttctttggggccaactcacttttagcaacgatgggagcttcgtatgagctcgctctactattatattgatgcatacacgagcgctgctagcctaat

SEQ ID NO: 6230 - DNA, 385 bp, Bacillus thuringiensis
ggctaagaaactggtcacaaattattttccaaattattaatcacaccatgaattaaggctatttgaaaattttaactcctattcccaatcacccttatattttatatattcttataataaattaaaatttatatctatccaaatttattattatattaccaaccaaaaataatttaatttcatataattaaaaaattcttttgtaaacctaatatttttataacttaaacaatttataaacaaatagaaacttatataaaataaatgatcttttatacaaaatatacttatcaaactaaaataccttcacaattaaataattcccatacattttttgagaatctaaccacaattttaatatcattaaaataacaatttactaata

SEQ ID NO: 6231 - DNA, 152 bp, Bacillus thuringiensis
gagaattatgtggtactgagataatcactagagctaacatttttgccaactcactttcagcttcgatcggagcacgcgatgtgcaaagcctatcacctattggtgcactcacgagtgctgctcgactaatactactagtaacacacacctac

SEQ ID NO: 6232 - DNA, 151 bp, Bacillus thuringiensis
ctgaattatttgcaaacatcattcttgatagagcggaatttgttttcacatcacgcttagcatcgatcggaggcacgtgctgtgtaagcctcaccttagtttactgcatatcagagtgctgttctactaatactagcagtggcaacactca

SEQ ID NO: 6233 - DNA, 149 bp, Bacillus thuringiensis
gagaattatgcggtgctggcataaccactagagcttacattggggccatatcacttttggcatcgatgggaggatccgacgagctagcctgtatcatcaattgatgcagacacgagtgcttctagcctaatcttactcgggccacacac

SEQ ID NO: 6234 - DNA, 127 bp, Bacillus thuringiensis
gcgaattatgcggtactgacataatcacgagtggttacattggggccaactcacttttggcttcgatgggagcaccgtatgtgcacgccttatcatattttggtgcagacacgagtgctgcgcgcct

SEQ ID NO: 6235 - DNA, 137 bp, Bacillus thuringiensis
atatggataaatacacctgctggtctatcctaagctatgctgtggaccacacctggtggggtcccgagcgcgatactcgatgtattctatatgtggcatctaaatgagccgcacaattaaatggagcgcctggtgac

SEQ ID NO: 6236 - DNA, 147 bp, Bacillus thuringiensis
gcttaataggaaattcgtctattcactttcgcaatttgttatcgtgatttaacgttaataatcataagagagaagttatatattgaatacaattgattaaagaatcaataaaatggtcttactgactattgatttctcgatctctac

SEQ ID NO: 6237 - DNA, 388 bp, Bacillus thuringiensis
tatattaaatgtaaaaccatgaacctccttaaccgactcatgttacatttaaactcaaaacccccctactatttcaacaactacaataaaaattatcttttcccatattaacttaattttactccatcacaataattaatcaccttactattacccatttcattcacaactatctactattataatataattatatatattactctactaatcctattaacatttattttctaacattaatttaaatcttaacactcaaaaacaccctcctccctataataaattactatatatttaaactctttcaaacaatcattatactcctaaaataatataattttcctcctatatattccattcccaaatttatatcccttcttaaaaaaaa

SEQ ID NO: 6238 - DNA, 103 bp, Bacillus thuringiensis
cggatccagcatgcgggatctgcgatcgctcttgcaagcacgtgcactacctgttttgttactggcaattggctgcgttgatatttgggtgcaattgacgggt

SEQ ID NO: 6239 - DNA, 331 bp, Bacillus thuringiensis
ctgacttctgggcaaagagctatctgcatgaaccggaaatttttaacaaatcatgcacatatgtcgatcggaagacatgatttgtaagtcgcaccgtagtgtagtccattaaagcgcgctgtgcaactgaaactggcagggctgagaccgcacactggaacgcggcataagaagaggactgaacttcagcccgcgagctgttcgacatatgagcacacatgctagcatgtctggccaagtgcgacatgatgagctatagcttcaatgaatggcataccttgcaccaaactgtttgggtaaataacgtattatgtgagggaaaggcgtgctt

SEQ ID NO: 6240 - DNA, 160 bp, Bacillus thuringiensis
cggacttccgtgcaaagagatatagggatgaacggcaattattttacatatcatgcttatcagcgttcgctgccggtgatttgtaagtttctccgttgtgtcccccaatccagggcccagtgcaactgaaactagcaggggtgaaaccaaactctggaac

SEQ ID NO: 6241 - DNA, 543 bp, Bacillus thuringiensis
aaaataaaataaaaaaaataattatattcaacttttttaaataaaaacaaatattctattataaaaatttaaaaaaattaaaaaaaaaaattcaaataaataaatatatataaaaaataaaataataaataaaataaaaaaaaaaaaaataaattaaataaaacaaacatattccaaattactatatacataaaaataaaaaaaaatattaaaaatatatataataataccaaaaataaacttaaaaatcattaaaaaaatatctaaatatataaaaaattcaaaataaaaaaaaaaaaatttaaaacaacaatacaatattattatttaaaaaaaaaaaaaaaatctcatctaaaaaaaaataaaacaccacatatatatattattattataaaaaaaaaattaaaaaattttaataaaaataataaaaatataaaacacttataataaaaaaaacaaaatataaattaaataaaatacatattctaaatactattaaaaaaaaaaaattcataactatttatatataataataaaaaaaaa

SEQ ID NO: 6242 - DNA, 264 bp, Bacillus thuringiensis
gaggaaggcgggtttttggatcgcatgcgttacgggtcagccgaggggttttgggcggaccaaagtgttgtaaaaaactcacatgaagcatggccgatcctctgagatgatgcactcatctgtttcttaggccgatatacagaaactgccactcttatgccatcatttgcagcgatgcaaggtgcatatatacaagtggactatatggatggcctctgtacgaatggcgattagaacaacttgacagcagctaatgtgaaggtt

SEQ ID NO: 6243 - DNA, 248 bp, Bacillus thuringiensis
  unsure (1)...(248): unsure at all n locations
aaacgaaacgaaagaagcgnncggcnggacataaagagnaggggccggaacaacccaacgcggaagagagctgggnacgacaatgcgcccgcacggcaacacgatcgcacccaagccaccaaacgcaccgacaaaggaggagacagacgacacgccacgcacaagagaaaaagcaaacacggaaggcacggagggagaaaaaagagcagaaacccaaaaacagcaacagacaccgaagaaggaaaaac

SEQ ID NO: 6244 - DNA, 324 bp, Bacillus thuringiensis
aacaatattgccggaaaacaacactctctaacagccttctagaaaaaaagtgaacagtgttatatataagaacatggggcacttatcaacgcagactactaagaaacagtaagccatacagcgaaaatcacagccatcaatgagacacttaaaagcacccctactactgaaacgatagaagtgagaatgtactcaggctcaagcgggggatctgctactaaaggccgaggaaaccttgataaaataaaggcagataacgtccgtaataacgcactaggaactgcgagagacataaccttatactacaccgcaggtcaaactggt

SEQ ID NO: 6245 - DNA, 128 bp, Bacillus thuringiensis
  unsure (1)...(128): unsure at all n locations
caagacgaccaaaaagcggcagaacccgaaaaacccccccccgaaggagggacgaggaaaaaacaaccgcccaaacgnacaaggacaacagaccgccgccggccaaaacgagggcccccagaaaaaag

SEQ ID NO: 6246 - DNA, 168 bp, Bacillus thuringiensis
gacagtcggatcgtttagtggaccgatgatttttttttggacaatcggaagataaatagtgggggctatgattgaagctagcggcgggtctcaaatagtgatatggccacataagacaatgggctcttactctatcacactacctatatttgctccaacaacctcaaa

SEQ ID NO: 6247 - DNA, 415 bp, Bacillus thuringiensis
caggtcagttcttttgaccatatgcccagcctcaggccgggagccctgtatagctcaaaaggcagtgtttaattcatacgctactcccacgggaccaggctaacgggtcacgaccacacagtacgaggtggggatacctgattggactatgaacatgccagacaatcgcccgtcaaagcccactgattcgctctactcagccgaccctaacgagtgccgatttcgtgaagaacaaactagctgcagaaagcgggaccgctttctgataggatacgctccgggtgttttagaaataccgaggtatatctgtataggctgaagtgggggcacgcacacctcactctgtcggtcctaaatgccttatccgttcgctatgatggtgcagaaaatccggtaccacccgatggaactgctc

SEQ ID NO: 6248 - DNA, 207 bp, Bacillus thuringiensis
cgtgatgacgatcgtatagaaacattgatagaagattattttttgtcatatgcgatatcacttacgggacgggttactagatgctcgcggggggatcaaaccctctcaaagggcggcttagcttagtgcacgttactactacaccacccgtataattgacatctggccctaagctaccataactatgccggccatcattgcgataca

SEQ ID NO: 6249 - DNA, 424 bp, Bacillus thuringiensis
agttgcatttatatatcaagaagataatataaacgtattagctgtatatcctgagcctgttttaaataaagatgtggttaagtacggatacgggaccaatatgaaaaaattgccgcagtcttataaatgaatatgatcctttgtatggcgccattaaggccgcagattttgtaatacctggacaggtttataaaatggaaaatggggaagggcattcttttttatatgatccaaaattttattctaggaatgggaatgtagcaatagataaattgaaaaaggttagcgaaacaggatttgattggaaatttggttttttagaaatatcagaatctgctggggacctatataaaggaatcactggaaaaaaaacattaagtacaacagaagaagttgtagtggatttagtggtaaatggaacccc

SEQ ID NO: 6250 - DNA, 274 bp, Bacillus thuringiensis
aaaataaaaccggcctagggtgggattttttaaaaaccctgggccgttccccccttaattaaccggggcttttaccgaccggtttattaaaaaagaaattggccctcttggagatttttttacccccattggaaaaaccttttttttaaaggccaagggttccggggctcaagggcctgccttttagggaagagccattcccgggagggttcccgagggtggtcaaaggacccaaggggttggaattggggactcaaaaagttttatcgggggt

SEQ ID NO: 6251 - DNA, 162 bp, Bacillus thuringiensis
agagctataatagtgatgatctatattgtggtatgcataatgacaaacatatttccatacagctgaattgactttggtgatcatatttacgcacaatgacgcccagtctattttccaacagctgaacttatgtgctggttttggtacaatagcagacacgct

SEQ ID NO: 6252 - DNA, 316 bp, Bacillus thuringiensis
tcaacaaggatccagatgcctgtcgggggggaaatttctacgtgttggggggacctacatcacgcaaaaaattcccattactataaaacgcttatcagaatagctgaaataatgttgatcgggaataaagctaacgctgaccggttaaacatggaccgaagcctatagattaatccaactagaaacgtgtattaaattgtcgaatattagaacgacgacataaaccacattcatattccaccgggaacatcaacccgaaacatcgatcaataggcatactgcgaaccacccattattgaacacactcgggccctct

SEQ ID NO: 6253 - DNA, 222 bp, Bacillus thuringiensis
cgcagcgaacacggtgagaaccacgaacccgaatgtggagcactaaagcgacatgctactacgaagctgctaacatagggaaaaggcagatgagcgaccaggtatcactcagggaactggacgaaccgcacaacgcgatacctgacatgccattcgagagacgcgacacactgactggagaggactgaacgaacctggctcaagaagaacgcatgcggcgag

SEQ ID NO: 6254 - DNA, 420 bp, Bacillus thuringiensis
ggatccgagtggttgctagaggcggtatatctctgttatatggggttccacatcacgccaaaagtagtttgtttgaaaagcccttatcatatcgaagacatttgtatgatagggaatggaagaaactcttgcctgttgaacaaggactgacagtgaatgaacacccgttgtactcgatccgatagaaaagtttacagcttgttcagactaaacactcccatattttttcccaagtggagttcgatctgaaagagggtggaacactgtaccgacgccacaaccgacctccacgatgattcgatctctacaaatatgaactttcagtcatgcccaattggcaagactcatatgcgcactgttcataaccctacgaacaggacgatccaattgtcccacgaggctttatcgatagctggatta

SEQ ID NO: 6255 - DNA, 452 bp, Bacillus thuringiensis
  unsure (1)...(452): unsure at all n locations
aaacttggctatcgtttgagagcaacctatcgctaaacacaaaccattccttttacacagtccattgaaaggaagaaagcgggggtgtaaattcatgttccttttacacagacctccaaaactcgaataggccaatcttacttttcctcattctagaggttgcaagggaagaaaacaagattggttctttatgaaacctggttcaaagcaacgaactccgctctctcccgtgggcacattcctattatagtaaacggggacttctctctttattcctatgcgtgctttacttgactcctctgaattcagaacaatgacttttaggctatttttccccaccggcaagaatgaacttctatgtgttaagcaaagaagaacagaagatctattccagtagttaggtacaatcttggacggccggngacctactttcgcggaccgcctaaaaggac

SEQ ID NO: 6256 - DNA, 337 bp, Bacillus thuringiensis
tcgtgatataagaagaaagaggttgcctcttgctactgctcctcttgcaccataagcaactctccgaccaaagtggtttttaaaaacaacgggcgtttaaccccctttatccactctaaacttcttctataaagtgggcacagcggaactacccaccaaattcaccccttaattcaggtaccacctgacaactctcgccaaccaacgatttaaaaacgatcaccatctacaatcaccaagggcgcaaacttgattaccatacccagaattttcttccaaaacaaacaggatcagtgttcgctaacgacacaaatgctaagcgctatacctacaacca

SEQ ID NO: 6257 - DNA, 329 bp, Bacillus thuringiensis
tgggtccattaggtgcaacaggggatcgatagttttttcagctcacagcgcactaacatagcaaatgagacatgttataggaaatcgcggccaaggatgaatcagatgaaacattgacactaagatgacatgacacgaatttatgcctgatccactctgaagcaaattgtatactcttcagatgatacatgattatctgacgcaatgttatccgcgggaatactgattgccatgcttaagaagaacatactggatccggtggctatatcggcgatgccctagctgaggctctgcgcaataaggattaaacatctgataattactgcgcc

SEQ ID NO: 6258 - DNA, 482 bp, Bacillus thuringiensis
ggaagcggcggaggtggtgtggctgagatttcgcccctgttgttagaaacgccgaccggcaccttcccaggcgggacgaacctgacgccgcgaacatgtttcagtctcccgggaaaaaactaagcactcaaaaacgagaacgacgagagacagacagagagacgcttaatagtcttaaagggagttacatttttttaattgagagaaagaaatcaatggtgttacaggaaaacatgtcgtgcacccacttaactagtagatgatgttcattgatgcgtgtagcacatcaagtctatatgtttttggggtgggcagacgcagatgtttttggcccaagtaataaatatatatcataaggcatagatgggcttgtcatatcatatcatcattcagacatgcaccgaataaatacatatccgcgctgcatgctccaaaacagaggggagcttacagcatcaccaacgtccgatacttaacctagc

SEQ ID NO: 6259 - DNA, 310 bp, Bacillus thuringiensis
cgctgcggacttggttagatccacgaacccgcaagtggtgcacggaggcggcacggtacaacgaagatgcgaacatagtgaaaaggcaaatgagcgaccagctatcactcagaaaactgaacgaaccaaacaacgagatacctgaattgccattcgagaggctctacaatgtgactgtagagtacagaacgatcctggtttaagaagaacgctggcggcgagcgtaatgcattcgcgcggagcgaatacaggatgagcccgctccacataagaaagcttcacacgggcgaataacaggtgagcaccctgc

SEQ ID NO: 6260 - DNA, 450 bp, Bacillus thuringiensis
cgctatggttacagcacgggtttactgtggctttatctcagatgcttagtgaccctaacccatttgcttaaccttacagcaccgggcaggggtgaccccatatactgcgacttacggctatgcacagagctgtgactcaggtatacagacgctagaggctatgcactgtagcttatcgactagaaagcaccgcttttcccgaagttactgtgaaatgttggcgagtgccttagccagaggtttgtcgcacacactatgatcttctactcgactacctgtgccagcatgtggcacaggtacattctatgtatctagaagctatgcttggcctgggagaacaaatgacttcgctgcataaggtgcttacgcatcacaggtcactatacacgataagcggatgagcgtacttatcagtcgagctgcttgaacgtgcacaaccaatcgcacgct

SEQ ID NO: 6261 - DNA, 365 bp, Bacillus thuringiensis
ctacagctgattaccaaataattttttgggtacaaaccgccgactgaaccgtggggggtcattgtaaactgtgagactcgagtgcaaagttggaacgtggtattccatctcatgcggtgtaaagcgttgagaaatcgaggaacaccccagacgaaggcgactaacaggacggaaactgacactcgggcccacaagcgtggggagcacacacgagtagataccctggtcgtacaggcgccctcccaagaactcttactggtagaggggtaccgcgctttggtgctacagctatcgcatttggaactgagcctggggcgcaccagacgcatgggttaatctcaaaggaagtgtcagtggccgccaca

SEQ ID NO: 6262 - DNA, 145 bp, Bacillus thuringiensis
gtgactgttccggaatcgccacacctttggtgactgtatgttgcaaccaatccggggcattctgtgcccgaggaccttgaacagttctgacgcatgccactgcagcttctaaaataagcatagaatgagcgttacggtgtattat

SEQ ID NO: 6263 - DNA, 370 bp, Bacillus thuringiensis
tgactaattatttttgcggtacaagccgacggttcaacatgggggggccatagcaaactgatagactggagtgcaaaagaggaaagtgataatgcatatgtagcggtgaaaggcgtaaaatatggaggaacaactgtgacgaaggcgactatctggacggaaacagtcacaaaggtgcgaaagcttggggggcagacaggataaaatacccgggtagtgcacgccgtaaactatgaatgctaaaagcttgaggggctccgccctttaatgcataagctaacgcactaagagcggcgcctggggagttcggccgtatggctgtaactcaaaggatgggtcggtggcctccacaatccgtggagcacgagcg

SEQ ID NO: 6264 - DNA, 463 bp, Bacillus thuringiensis
aacgcctggtttatgggcgtatgcttacgagaggggctgcatagatggtctaagcaatttgagtaagcataaactcttcactagaagcacgtagagaacgtagctgacgagagattatctgatcgactaacgtcaaccaactgtaggaagcggattcggaccattaggctgtgacgcctcaccaacagggctatggtatgaatgcatatggccatacgctgtcagagggagctcatcattaggaactagtagttggacgtactatcaagagtccatatactctgtctatggatcgtacgaaggactgcttggctatagtatttgcggcattgaaatatccatggctcctgtggctatagatcaagcaatgagtgcattctctataatataagaagatgtgcttgcaatgaagggagactatgtatcatgcgacgagagagggcttacactataggggatgact

SEQ ID NO: 6265 - DNA, 227 bp, Bacillus thuringiensis
  unsure (1)...(227): unsure at all n locations
ccaggctcagaagcttgncactaattttgaagccgaagtaacaaccctcacaacnanaggncaggaggaactttttggaagagcaggggggccaccccacaagcgcacaacaagaaacaagaaacgaaaccaacaaggacgccggccgcgaagaaaccgacgcaacccaacagaaacaccacgcgaaaaacaaacacaccacaaaagccccacacggacaggaacgg

SEQ ID NO: 6266 - DNA, 416 bp, Bacillus thuringiensis
aaaagccatttttatagacaggcagcgccataaaaccttagtgggaccatttgggctaaaataagggaaagaacccaacgtcactcgcaggtaaacaaagcacgtactcaaagccccaggaccaatccctttacacgcggatgatttattactgcggaatggataaaggaccaaagcacactcaaatccgggaaaggcattggttatagatgtaactgtgttgaaaactggcctccatccgtatttaaggaaaggaagatgatagatccaatgcccatctaaaggcgggatgaaacatacaaatgccatccacagtgctattttgacgggacaaacagcttagcggctattgataagaccacctaggtttgcaagcatcaccaccggactagataatagcatcatgatcaaaaaca

SEQ ID NO: 6267 - DNA, 329 bp, Bacillus thuringiensis
gaaggctgtcatgcatagcccataaaagttttttgttgaataaaaacatgtcacatgatagggacggtcttttgttatcgacttgactattgctgtaaagcgtaattatatatgcacgagaggggaaccactgtattattctcactaagcatatgagacgaatctatgcggtggatctgatagattacacaaagtgaaactttagtgagttgaacatgtcgagttaatactagaacgtccatgaagaaggggatcgattaaatgaatacaacaattggacttaaacaatttggaataactcgcgaggcagtacctaaataaagggagac

SEQ ID NO: 6268 - DNA, 159 bp, Bacillus thuringiensis
  unsure (1)...(159): unsure at all n locations
agaaaccacacagagggaattttagggacaaagccggaaaaccaacnaacnagcgnnagagacacgaggaaaagacaaacgcaagaagacaaggaaaagcgagaaacgagacaagacgaggaacaaaagcacacagaggaggnaanacnaccaaaacaa

SEQ ID NO: 6269 - DNA, 143 bp, Bacillus thuringiensis
tttggacgcgatcacctgcatcaagagcttttactttctgttgaccgcacataaacaccgggggggtaatgtccctgtgagcttttcttgccaccaaagcggacagatgttcaatcggtcttagctgtacaacagccaccact

SEQ ID NO: 6270 - DNA, 313 bp, Bacillus thuringiensis
agatctattagtgaaagtccctcaggagagtttatgttctttgaaggcaatgcagagcatgctgatgccatttactctcaaacagggagctttaagaaccaggcggttatgacatacatttcgtatgttggttaaggttagctattaaatgctatcgctatgatcgtcagtgcactatgaggagaacgcacggtggtcctaaaaacatggtagggccttcttcacaatagagtgtcgagataaatatacgcatacattatagcgattagtatcgatggatggggtgtgactttgacaacccgtttcattaggc

SEQ ID NO: 6271 - DNA, 288 bp, Bacillus thuringiensis
gattggcgacacgcatggactctggagcactttctttggaacatggtatactccgttatagggcaggcgtttttgaaagcgcatgtcctgtgctgttaacgaaatgcacctataccggtaatgtacttaaccgactatctctacagctcgtgttgacacaaacacaatcgattgatgggagctctggcatattaacgctaagtagtggctatcatctatcgaactaacgctagccctgacagaaaataaggcatgcctctggtacaacaaccgatggggctccagaaa

SEQ ID NO: 6272 - DNA, 377 bp, Bacillus thuringiensis
atgggacgtgtccctaatgatccgaaaatcgagatatttattctagcggacaataacgactttaaagaccagtatatgcgagactttgaaagactaaacggtgcatatacacaagatgtacaagatgcaccagctgctgaaggagccttcattaaataccatatcattatctaaagatatgggtatggaataagagcagatctacgtgttgtatggacaaatgcatgaatacgcgcgcggtgaaagcactcgaaaataaatcgcctgtccacccttctagataagcctgttcgctattataatcaggcggagaatgaagcggaattaaatgatatagatgaactcgatgcatatacgcggtcgatgctacctgattt

SEQ ID NO: 6273 - DNA, 184 bp, Bacillus thuringiensis
aaaccgatcctgttgggtaatgagatctagaagatggttcgagggaggtctttccattacattggggcacgttattgtttgctaacaggagcttcgtgtggaatatctacaagtgagcctaagaaaaacgcatgaaatgaaaacacggaacaaactatacataacacaggggacgacacatgag

SEQ ID NO: 6274 - DNA, 262 bp, Bacillus thuringiensis
gatactactgattccgcggcattatgttcatgcgatagggcaccatctctgggggggctttattagacatactggggggtttatccaccatttgatagctatccataatgggcattctattcggcctttgattgccatccgtgattgccagcatattacggaaccgaccgctatgcataattgggatcaaagtcgggcttcgattgtcctccatcattggcatcatagtcggcactcgggtcttatccctcgtaggcattat

SEQ ID NO: 6275 - DNA, 344 bp, Bacillus thuringiensis
  unsure (1)...(344): unsure at all n locations
caaacactatcaatcgccgcttttatttctggaggcaagcttcccacacccagggggggttatattaaatatgggtccgattacaaaactgtcgcacgcgntaaacaaaatagacgcggatgaaaattaaatagatacacatggtcaattgaaccaaaaataacgagcgtatcggcgtctactaagaacggtaccgattgtgccgcgctatatatgaaagatgccccgccagatcctttaagacatactgcggaaacagaaactggaaaaccacataggccgactactgttactaaatttccaccttagggctattaataggaacctttatgttcatgaatact

SEQ ID NO: 6276 - DNA, 286 bp, Bacillus thuringiensis
agaccaaatgagttgctctacccccgggcagaggccgacagcggggggggtagtgggcctcattgaaccatgcactctcgaacttccaagggaatacgcatgtgaaaggaacgcgccatatcatgattgagatggaaggtgctattggctaaataggaaggcggagccgactgatagaccgcgtggctaagggtcttccgcacacaaaacgcccaagatctcctagtgcggaaggttcctaaacaggacggcctaggaagacacgctgaataatctctgtaagaga

SEQ ID NO: 6277 - DNA, 215 bp, Bacillus thuringiensis
caacaatgatttgttttagggcccgcccagaagaactgctgggagcgtcttttgtatgcactcatcatcaaacttagaacgataagccgggcgatacaatacctttcagggaagatacgcacgttaaactcacgatactgaaagacggggtaacggcccatactggaatgtgcccttgctctaaagaggaagagaggactaatgaacacgctcac

SEQ ID NO: 6278 - DNA, 385 bp, Bacillus thuringiensis
cgtgcactaatccatgtgcatgccctgcctttttttttgatgatccttacattccttgtgcggtgggctactttcaagcaatttctcctgatcctaaaccagatcttaagtataccagtgccggattataaagtgtcttcatgctattcctcctgatgtcaactttatatattggctgcagttatatcaagctaaggtcattaacggagtatgaacaaagtattacacctaatttttgaaaaaaaaaaaggcattcctcaaagaataatggaagaatggcgtgttcaaatatatttgcaaatccttcgagtgagaaagcacctgacacagaacagctcaacagcaactagcctaataatcaccttgtacattccttaattaatac

SEQ ID NO: 6279 - DNA, 273 bp, Bacillus thuringiensis
ctgacattcactatgattcactacgcatatttactttatggcgcacgaactgcattgcatgaaggggccacttacctgggaagctccatccctgaagaacagcgaacattccaatatacagattaagaccgtcaaacaaccttattccatgccatacgcaggacagcgagtgcactattagtgagatccacggatccactagagacatggtgaaggaattcatcccatttgcacggctgagccaatctattcgtcattgatagcaatgagtac

SEQ ID NO: 6280 - DNA, 194 bp, Bacillus thuringiensis
tacgtggcatattgttggaatgtaaaggctacgcaagctttggggggtacctgctaaccttgaagagccttttctgacggtgatactttaacttggtacgcacggtttcgcaggatgggttttgaatcattccaagccacacgagggctgttaacgctaagtgcgagggctttcgttgctgcgtgtatgggtag

SEQ ID NO: 6281 - DNA, 294 bp, Bacillus thuringiensis
caccatcggttatagtacggccacaacgagatactaagggggtacatttgatgggacacagctccatattcactaagagggatggagagattggactggctcttagagaccaagcgcgactcaatcctcaacatgatgaaggtacatttataggctatggcaaaaatttatccgcgtaacacatatagacagtggttgttgaagctcgatcactgacgggcatgggcgtgctatctggacaaaagggttgggttctatgcaccgacacgcttacgaaggcgaaccatagatgat

SEQ ID NO: 6282 - DNA, 340 bp, Bacillus thuringiensis
cacctctataaatttttcttaccgtcacccttgctaaaactggatcgaccgctatctgtaataagggatgggacaccttagctaaatataccctcaattacgacatatatctaatgcgaagcctacatgtgacaaacgcgtaacaatacatgacaatacacctcacacggttacaccaaatctgactgttacaacacatgacatcacatactattatgtttaccaaggactttctagtacaaaacctattttcaaaagggaacctttattcattgcgacgacgacagaacgagagataagacattctcatgagatcaaagtcaaacatggatgattttga

SEQ ID NO: 6283 - DNA, 314 bp, Bacillus thuringiensis
gaatacagaacgcattaagaccggttgttgctctcgtggaagaacaactgccgcgggggtaaatataggacctatggagctccctactcctaaggctgctggagcacacgtaaaagatggcctctcctaacaggcagctgacttacacgccatgacccttttaccaaatttataacacattcaacgtctttcttaagctgtgtggaacatacttggtggtgatacgaacggcgcccctttagagtacaactgcggaaagaaacagtctagtgcacctacagactcttgacaaggcccacctggggacgaacgct

SEQ ID NO: 6284 - DNA, 136 bp, Bacillus thuringiensis
aacctatatgcgacctccccgattttgatctgggtaaaaccgtcggtgactgcattcctgactactactccttatggggccagtgggttcttacccacctgtgaccgaaccgtgtttatgaaagcattcgcttcat

SEQ ID NO: 6285 - DNA, 407 bp, Bacillus thuringiensis
ggtgggatcacagcacagacgaagaagatgtgagagagacatcatcgtcatgatcttgtttacgaaaaagactctcatataattcaggagcgggcactatcggtcactaatcgcctcttgaaccaaaccactggacacagccacactgtaggtgctcctagttgcagacgctccacctctcgagcatagccctgtggtgaccctttgggtgccagaatcaggacccgactaagacgttcagactcctaaggagtcacgcgcggaattcttgagaagctctcgctttcgctatggtccagccccgagcccttgagcaagcctaaccagctcgttgacaaggcccgtgcttgtcttaagccttatggatacgcctatttagccataccccaggatcgtccgattgaacg

SEQ ID NO: 6286 - DNA, 290 bp, Bacillus thuringiensis
cgccttcgggattatcgataagaggctcgatgatattgttaatgaagtatctctgagacaaccaatcagaaagtcacagagggggtaagacgtattagagctcctgaactacgcgctttaactatgtctgtacaaccagagacgtctgtgaatgagactgaccatgcctatgcagagaaaacagtatctaactaagcggcgctagatgtggagagtctggctccaattttaaaagacggcatacttactcgtatactgatttcccctgggatgatgaccctcgttgcccg

SEQ ID NO: 6287 - DNA, 312 bp, Bacillus thuringiensis
caacatgccttgtggaagagcgcgaatagctcattaattcctttcacaccatgcaaaatgaaacttagtaagggaacatataaagatgcttgcatcgataatgcacgttctccgaatatataatcacggtacggtacagtgaaatatcaccctggtgttaaaacaccgattttatgggggaagacttgatgtgtatttgataggagcccaagggataaaagcggttttggtcgtggacgcaagtataatgaatgaacacgctgatcataacccggatcgtcatatgcctttggttgtgcgtgaagtacagca

SEQ ID NO: 6288 - DNA, 190 bp, Bacillus thuringiensis
tggcggattagaaaggagaggcaacaaagacaacggatgcggccactaggacactagcctggggaaaggaaccgctgtgggtctgcaccacaaacgacgcgcttaatgacacaacacagtgggaccgcgggcgacacttaccggtgactatggagacagtaccgcgaatagaagacatcagcgaaataca

SEQ ID NO: 6289 - DNA, 422 bp, Bacillus thuringiensis
aaaacccggggaatatataccccccctaatactatgttaatggggggaactaacaggaaggcgcgtcagtttcactcgacaggaacaggatacatgcctgaatttgatatgaaacagaggaacttatatactgtttcagtatagccattaagtgtgctagtgctcattcgaatactctgatactcccacctaaacatggggaacgctgctaacgacattcccagaatcggctacctatatcatcatactacttgaactgaacccgcaaaggaatcacgaaatgcatacgacagacatggactactagaattcagaacgctaaggatgaagcatttaaccaaatgccgatgggaattacgcaatacagaacgattatggcatcgattggccaaatcctgagttatttaacgccggggacagca

SEQ ID NO: 6290 - DNA, 147 bp, Bacillus thuringiensis
gcgcattatatactgacactgccttttcccctactgtcttccgtgctgccacgactatcaaaacatcgggggggacttctgctgtgactccagctaataccgcccacccagatgggatcacattcgctccacctagctgatcctgca

SEQ ID NO: 6291 - DNA, 161 bp, Bacillus thuringiensis
cttggggaatgactacacttcttaataccttcgttgaagtctaaggtctctagacaattagcgtagcatatgcttgaaggactgagggaggtgttatttacacagattgcatccgtaccaacaatagcttttggtccaggatagaccattgtggctcactg

SEQ ID NO: 6292 - DNA, 230 bp, Bacillus thuringiensis
agatcaagaggttaaagcatttgcctagaaaaagatttctgttggtgcaacaggtggaccacatgtacaacgttttgaataggtcacagacgttgctgcacaagatggcctcgacattgatatacatgtatcgaatgagtatgtagcgccaatcgttttattagctgaaacaagcctcgatgtatattgcctccagaccaaatcgaatttagaggtattcaaagctgaac

SEQ ID NO: 6293 - DNA, 107 bp, Bacillus thuringiensis
ctgtggagacaccgggtacttaataaaataagatacttggacccggtcgatgcagatatggtgctgacataggaatccggggaccctgtccttgaatacttagacgt

SEQ ID NO: 6294 - DNA, 104 bp, Bacillus thuringiensis
aatagaacagttatcgcggggggttttttcacactactaacgcgcccaacaacctagtgaagtgattttgtgagatgccccaaccatagagacgttcattaacg

SEQ ID NO: 6295 - DNA, 107 bp, Bacillus thuringiensis
ctagcgcagccctgataattaacccacatccaacgctctgcctaggggggcaattaacacacattcattgggattctctcacagaccgcttaccagtcgggataccc

SEQ ID NO: 6296 - DNA, 193 bp, Bacillus thuringiensis
actttcaaagacagagcggctgtgtttaaatccgccttctatatacccgccgcttcacgttcaccagcaggggcgctctttcgaatcgttccccgtatattccccatcttataaatggaagattactgtataccaccaacacgccttcgtttatttcatcgcaaattccataaattttgctaaaccatatgca

SEQ ID NO: 6297 - DNA, 227 bp, Bacillus thuringiensis
gatggctcgtaatacatgttctatgctagcggatgtaagtttttttagaaagacggaaactaatgcgattgagggacctgtcttaaaagaagctcaaacacatgaacaacgcagccctacactataatttatgatcgaagcaatagacggttcagaatcatgagtatacaagatattctttgcttttacgtgtaacattggctacaacgtgtattgaagagagaact

SEQ ID NO: 6298 - DNA, 317 bp, Bacillus thuringiensis
catgagagcgagtaaatgattgaaggcaacttaagaaacggcgatgggtgtgctgcactggatggctcttatgcaaatccaggcatttcaggagcacttggaagaaacgggcaaagaaaacctttgccaagcagtggttgttgcttaaggggcagcagagaaaaaggttagagctggctgacatcaaaatgaacaggatcgagctgcttcaaacctcgcacataaacgtggaaacagatgatattcaatacttagctgctcacgggattgggcttagttaacttgaagctccaattcacattgaaagttaccttggc

SEQ ID NO: 6299 - DNA, 375 bp, Bacillus thuringiensis
gatctggcagaaattatgagactgctcctacttaggtaactcaagtgggtggtattactctattcgacaatactctataacctacgttgcgaccttgtccagcgtaaccgggtaaccccatatcacttagatctaaactgtatctatgggcagtacgaactgtaatattaattgcatcagcgatttattgcgctgtgaatgcttttgtcgcacaagcacacatccgattacctaacaagcgagaagctgaagactaacgtatgacccacgttctttgtaaacatgacatctattgccgagttttattgtgagcatattggtaccagcatatagctatcaagatgagattttttgaggattatttatttcacgtga

SEQ ID NO: 6300 - DNA, 206 bp, Bacillus thuringiensis
ataccagctcccccattaccgaaacacctcttcttagccgacgcaaaaaaaacaccaccgggggggttcttaaacagagtggcgggccacaccacgcgcgatgtatgacacttgactttacacaggatacatttggaggcaacgtccatactattcataaaaaaaacgttattcaaacatatgaaccacccttacgtcatgtggga

SEQ ID NO: 6301 - DNA, 273 bp, Bacillus thuringiensis
actacaacttttacaacccatttctcatacacaaaacaaggcagaaggaccccttaagaaaatatatacctactaaccccccatcaaccctcactactgtaccaacatatggaaagctcataatcgtaactccatatgttacaatacccgcctcaccgactaaaatgtttacaatccaaaatacaacccgcttatcaactcccacactagccactccatttacaggtacactattttgtacaaaaacaccttccccaaataagacatcgataa

SEQ ID NO: 6302 - DNA, 422 bp, Bacillus thuringiensis
ggttgcctgcggatttatttaaaagctgcgatgacagactgtctagagtagttgcatcctaaggattatgtcctgattggtgatggtggtgatccatacattgatgccaaactaccagatatgtaactataacggaaatccatgctatggattacgcgtagcaccgaatgatgatctggatggtgatcaaatggtgctatacgcatatgctaataaaaaactggacactaatgtacataaacacaaattacttgcggaaggctgttcatgatgggacggcgctatactagaagaacaacctgtgagtgatgagatagcatatgatagctgatgtaatgtaacgaagaaacagccttattaaaaggatgacatgaatgaggcaggtatgacaggtatagcatcaatcagtgtgaatggtgcat

SEQ ID NO: 6303 - DNA, 118 bp, Bacillus thuringiensis
caggacgaaattttttctgacatactatactcatttcaggagggcgaagcaatcgatttctgaggcaaacttgcaacagccacattcataccgcactcttcaccacgaaatcaaaaat

SEQ ID NO: 6304 - DNA, 122 bp, Bacillus thuringiensis
ggagactaatcccagtgtaagagcagactgttttttcacctggaacagtcacctttctggaggcttgagatcccactatttgccgggtcgcaagacccataactcaacattcatccaaagga

SEQ ID NO: 6305 - DNA, 119 bp, Bacillus thuringiensis
tgatatctttcttctcatatgttgaaactttccacacgatatctgttcggccttctttatcgcccactttgcgggacgacgttatctacacctgtctgtcttaatttcgtgatccaagt

SEQ ID NO: 6306 - DNA, 130 bp, Bacillus thuringiensis
gcccccaatttacatcccggcccctaatgtgtccgcacccacctaaactcggggggggtttttaaaaaaagggccgcttccaacacccgaaggcaagggccgttaccggcccgtgattttcaaacttctg

SEQ ID NO: 6307 - DNA, 190 bp, Bacillus thuringiensis
ctcctactataactactgttttttttgcacagcaagcagctgcacgatcaaggggttttgtagattctacggactttttacctcttttagccatatttatttcctcctcgaatgtggatttagctggaaataacctttccacgtctacgccctgctcttcaggtactaacctgagtgatgagccgccatc

SEQ ID NO: 6308 - DNA, 546 bp, Bacillus thuringiensis
  unsure (1)...(546): unsure at all n locations
cacaaaatgaaaccagacacaggatcgggggggccttaacaaaaattagcgcgaaatagatcacagccctaaacggataccggagcacaggataactttttcctacgcggtaagtgcgagcgcaatcacgaattcctgttgaaactgaatccccaatgtggcagtcttggggcctttaagacgcgatacgcggatcactgcgcaataaataataatgcgtatattcacgctcccaatcaacattcgtatctacacctggaaaaatgtgttactatgagaatgagactgggggcttcaaaaggagaggagagacttgatctacgcacatgtgggccccttaccacgcgatgcttcgtactcacaatgggactgtatggtaagacttcggaggatgattgacttaaccagatgcaacccttcaggttatgacttctcagcctctataactgtaagaaatacatntctattctttatacattgcccagctttagttatacagttttgagcaacagaaagtgaactaagacactcctagaagataggaga

SEQ ID NO: 6309 - DNA, 254 bp, Bacillus thuringiensis
tatctaaatcaatgaaatgttgtgacggggcttctttgcgtgattcgaggggaccctgcgtacaacttactggctcaatcaactttattagtagcgcgggaaatgcgtttttacaaaaagcgacacctatcgagtgaaagtctaagtccataacctcgcgagctgcttcatctactagcacgcacacaaccggcatgctcaattagttcagttaaatgcatcgattactatctcttctgagtcactaggagagg

SEQ ID NO: 6310 - DNA, 158 bp, Bacillus thuringiensis
ctttcaaaaactatttgtccttcccccaatggacgccatacaaggggggcacgttcggaattgcggggggacaacataacaaacggccctcctcacgcaagattcgcctcatgatgcggagtaaaatcctgaccatccacggtaaccagaaggacaat

SEQ ID NO: 6311 - DNA, 222 bp, Bacillus thuringiensis
ccactccattttttacatccactattcgaagaatttcctcaggggccgttttcttatatccatccatgctttgaacatatccctccttatttgtatacaactcatttgctgtatgcataaaagtattcgtacttaccttgtcttggagcataactcccgcactacccttgccgtgaaaaatattcagcattcacaactttgatcttcccctgctggaacctg

SEQ ID NO: 6312 - DNA, 165 bp, Bacillus thuringiensis
cgtgatactctatatgtgaaaaaggagttggagggcatggttttttcgttgtacgaccttttcttttttagcgagctagtaatcacacgtaatgctatgatggaaaatatggatttttttgcaccttgttctgatcgtgcaagatgattcattcttccttctaaa

SEQ ID NO: 6313 - DNA, 175 bp, Bacillus thuringiensis
aacctatatcacgtattacaaaaaattgtttaacgattcatacccactaatcgagggggtgttcttagactcatatccttttagtaacacttgtaacagtctacgagcaaaattttctttattttttggtgcccacggagtaaattgtacagtgttaataaagaaccatcgttta

SEQ ID NO: 6314 - DNA, 141 bp, Bacillus thuringiensis
ttatccgctgtttctgaattgctcacgacagaaaattataagccggtgtataaaaaggaattctcactactggcttgtaaacacctagagactttcaaaccaaattcatcaaagagagctttctacttctaagtccaatgc

SEQ ID NO: 6315 - DNA, 546 bp, Bacillus thuringiensis
gaaatagaacctactggccctagctttcatgggctaatggaacccaaaccggtaaagcgctttatgtgtgatcccacatgtcttgtctttcatggtgtgtaatttcttaatgttccttgcttttctttgacaggaacctgatattgaatacgaaactgaccgtataaggattgcgttactaactatgaagtttccagaaaatcttgttgactttgcactggataggcttggtaatgtattcacaatgtctttggctttgcattcaaaattcaaacatgttacaaagttacacctttttgtccgtgtctattcatggtttaacatattagaatttcttcttttcaggttattttttgagtgattagacctcgtgtacattgcaagaccaatttctcactattgcacgatattttttctttgtcttcttatagattaaccatctcttcatactggaacttctgattgtatgacattttatatatgcaaactaaggaggcttataggatattataactctctgaaagagaaaaacatttatgaagctgt

SEQ ID NO: 6316 - DNA, 397 bp, Bacillus thuringiensis
acgcgttcttaatgggaaccagcatgggggagcatttgccttccttaaaaactctattacttgctcagtccgcataaagccatgatcaatggcctcacgaaagggtgcaactccgaatgcttgaaatgaaagccataccctcactgctctaaatgtacgggacagttcaatgacactccacccaagattcacttcaccttctatgataaggtgactgtctacttaatatactctgagatcacacggaaagaaacacttaaatattggcgtacgccgaataagtgcacgaccaacgttataaaggctgaagaagcgcataatatgccatctctaagcgctaaatgaattcagcacgactgaatttccactgtaataagctccacttgcgttttttcac

SEQ ID NO: 6317 - DNA, 476 bp, Bacillus thuringiensis
  unsure (1)...(476): unsure at all n locations
taccctaaagatttggctgatttgatagcttcaataatgttttaattattaggcattttcttcaaacaagattcaatgtcatcaatcgatctaccttgtgattgtagctccatcatcatcctatccttttcaaaatccaattcaaattttgatttcaatatgcgtaaatcataagaagaggatgagattttggatgctttaataaatgaaataccataagacgattccatggtaaagtgaaacggagctgatggaagatctctgtgagtcccatttcagtgacaacccaattgtcactatctccgtcgatcaaagtccgatcgaaatcaaataatatcacgatttttgccattttctgagatataaacgcaacgccggagctctgcttctcgccggagctgcaaatcacttctcctcttactaattggncgacggcacatccaattgtccgacgccacttttcgtcttgccaatga

SEQ ID NO: 6318 - DNA, 326 bp, Bacillus thuringiensis
aaacagccttactcccatcaaacgatgggcgatttgtttatcttcattaccgatcgctcattgcgggggaggcatcttcaaaacttggaggggttaaaaaacccactgtaatatgaagtgctactacacatcattgttgcccgactctttcctttttctataaataaggtgttaatgcaccttgtcgacgctgactcctttttcagactctgtacagaccttgcggagccatactcttcagcgaagcatatccatgcatcctaagcgagacatgggtttacatttatattataaccctactacggatatccaacatcctgactccc

SEQ ID NO: 6319 - DNA, 267 bp, Bacillus thuringiensis
agatgctttttttcccatgggagaagaaaatgtattagaaacgagacattagtttgaatagcatcctgtaagacaaacacaaggatctaggcctgtacaggcaaataaaacgaaggtgatggggaaaacagtaatgtgaactatgcgacatatggatggaataatggagatgactaagccccaactgtgcaattgcatttagcaggattagcgagcgtagctcgtatgagaccgagcaaatagcaccatacagaaggactgatacat

SEQ ID NO: 6320 - DNA, 532 bp, Bacillus thuringiensis
tggtgtgctcatatgtttccatgattgtattctcgacgaaacaaccaatgttgctttccactaggagtttgcagatcgtaaaaggacatatgatgtccaaggattcaacattactggctttttcacttgtacgttacatcaatacttcttctgttactaggtctgagtcaatgcatgctgctggattcggtctcaggatagagtcatttgctcaaaatatctctcgcacataatctcataacagctagagaagcatctaataaagcttcaagttggtttgtttgagtctgaatgatttgctaacaagtggttcctctctcattgcttgtagttgattttacacttaaagaactaaagcaactacgtataaagcagcgatatgcttttccggatcagcaatacaacggtttgctcgcctttctttcctgtattttggcttgtggaagatataaagtatgaactgcataatacaggaaatctttaccctgcccatattcttgcttgatttcaggaatgtaccctatcattacat

SEQ ID NO: 6321 - DNA, 286 bp, Bacillus thuringiensis
cgaagtcatttttttgcaggcccagcaggcatcagcccaagtggggatgataacgatgaagctagcgataattccctgggagtacgaccagaagggcgagcgctgacagggagctttcctgcatctacgtctacacagggaggaccgttccacatcagcttgcctaacaggccatagcacttgctcatgtggtatgcattgtctgagagcggagcgatcaatgggatcgcgctacctagacatgtaactagcgtaatatgcgattatttatactgatccgagccaa

SEQ ID NO: 6322 - DNA, 158 bp, Bacillus thuringiensis
catacaaccaccagcttgcagactatcacaaaacagcagtattcaccccataacctgcgtgcggtgaaaagagcgctctcgatatagacgcgtacgcgatcgaagcaagatagctataagttccgggatagatcgattacaagctctaacagaaactc

SEQ ID NO: 6323 - DNA, 155 bp, Bacillus thuringiensis
cccggtactttctattgtccacaaactagctctggtacccctggggttctccatgaggaaggccactgaccttaactgcattccacgtactgatcgctctccagaccagaaacccgccgttaaagatgaacttacgaactaaaccactcccggac

SEQ ID NO: 6324 - DNA, 263 bp, Bacillus thuringiensis
atacatgacccagcactttcgtaaccatcaacttgtattgtaccacgagctcataggaccgtgccggttggtcttataaacagatggggggccatacaaacagcggcttacagattatctcaaaaagcagtttttcgcctctgatatgagtgcggtgaaagaggcgcccttcatacagaccgatatgcgatagaaagaagatgcttgtaagttctgtacgagatcgtttacaatctctatcagtaaccgtagaattcaatgat

SEQ ID NO: 6325 - DNA, 108 bp, Bacillus thuringiensis
gaggttgtacagactgttttagaagtaaaaatattatagaaggacaggtaactagtattcaggggagtttatcctcaatggaagaaattacaaccggggtgcaaactg

SEQ ID NO: 6326 - DNA, 234 bp, Bacillus thuringiensis
gcccgaaaaggctggcccccaattcaaaacccgggacctcctcttttcccacaaccgggttcaaacccggggggggttcctatgggaaaggccctttaacactactcgctgcccgggaagtatccgttttttaacccataagcccgccataaaagtggacctccaaaaaaaacctcgccgggaactgttactccttttttacagtattttttacttcccaaaaaaaaaattccc

SEQ ID NO: 6327 - DNA, 248 bp, Bacillus thuringiensis
cggtgaaataggcattaacgattattgttactcatgccgctgtaagcttagagggggtactgtttgcttaatatggcacaacaccagcttttggaggcgaaatctctggatcggatggcgcagctgaatgaagttcacgctgtatgatgagtcgcatcaatttgctggcgagggccaacgcattaaaatacctgatgtatttgaacgacgacgatagcaaactcgtgttgtaaaccgagaatgtaagt

SEQ ID NO: 6328 - DNA, 262 bp, Bacillus thuringiensis
acggatcgggctacagctgatcccaaataccaaaaactgttcatagggggatccctaagttaggccgccactatcaaaactctggttcaccggcaacataccacactcagcacatgctgctacgattggttgatgactgattctaaaagccgggaatcaccggattgcactcacaacgattgttactgcaacagcacctggggcgagcccactcaaagagtttgcgcccacagcacgctctggatcagaacgaccttacgcc

SEQ ID NO: 6329 - DNA, 142 bp, Bacillus thuringiensis
caaacaaaaggtgggcccaaaatagagaggagtctaactgggggggttcttacatatatatggagcataacggacatagatatatcgctctggcccaactgattaaccaaggaagggttaacggaataaacttcattgatag

SEQ ID NO: 6330 - DNA, 304 bp, Bacillus thuringiensis
cacagttatttctgtcccccactagagagggcttccaccgagggggatctcctataggaatggcgctttccggacttacatatatcgcactgacccaactgtttaacaataaacgggtgttcagaatgaacttccttgctaggcccgagcgggtcatatagacaaaggctgcagtcttgcctaggtgcgtcaacgaaaattactccgagacaacgcccatgaattcagacaccgtccgcgtcacctggccaaaggccgtaccagacacactcctttaaacgggaaaagaaccccaacttcaacc

SEQ ID NO: 6331 - DNA, 242 bp, Bacillus thuringiensis
cgattaccgaagcattacttaatatgtctacgcaatcgctcatgaccgtacagaggcctccgtctacttattaccgagcaatccctactcttgatgacaaaatctcccgatcggctggcgttcatgcatatatcgagcgctttaagatgggcgccatttatatgctccagtgcgacaacgaaatacttatactcatatttccgaactaccccgacagcaagcttgttcaggaaatctataac

SEQ ID NO: 6332 - DNA, 119 bp, Bacillus thuringiensis
ttgtcgtcactcttgaatccttgcagaccttcttatttttcgcatcagtgaacgggcatgaaggggcgccatttttaaatgaattcatactacgaacagacattacctttcatctccct

SEQ ID NO: 6333 - DNA, 163 bp, Bacillus thuringiensis
gggcattggtaggcactctaggagtttgaacgatgttgtacatactgaggattataaccacattgagctaggagaaaacatcaaccctttattaatcaatcattgagatcaacactttgaaaaaagacagccacattgaaaggagcagaggggcttggcctaa

SEQ ID NO: 6334 - DNA, 113 bp, Bacillus thuringiensis
gacgcttttcgagagaccacgaatcgtgatgttaagaaagcacctctttctcccgaagaaacgggtatattccgccgagcttcttaaccagaggggggcttgttcaccttagg

SEQ ID NO: 6335 - DNA, 116 bp, Bacillus thuringiensis
cggcataattcaaggcaaatctatagtacgctggtgtccaacgaggattcacgcctgctacgcgcttataatgcgaatacactgcgattcactctcgcgtgacggcctttcaaagt

SEQ ID NO: 6336 - DNA, 144 bp, Bacillus thuringiensis
acttcatgattggatcagctgtgcttcgatattgatcgttacttactgctgatggcagacatgcagcctagggatccgttaagagtaactagggccgttttaaactcaattacacataaaagaaacagcattgttataattcca

SEQ ID NO: 6337 - DNA, 130 bp, Bacillus thuringiensis
aaagcctcggttcctaaaaaatgaaagcttttgttgagcccatgcaaaattgtgttctagaagggctaccttgcatgcgaaagcatcgttagtcaagcatgacctattactgaaaatgtctactgtcatc

SEQ ID NO: 6338 - DNA, 114 bp, Bacillus thuringiensis
aaatcactgtaataaactatatcgatttttcctattgtttaccgtaacagtcgctcacggactggggacatctgtaagctgaatatgaggcacttcctcataatacgcaaaaca

SEQ ID NO: 6339 - DNA, 294 bp, Bacillus thuringiensis
tttgtaatttggttaaaattttttatatattaaaagaataccctgagatgtggttgagttggttgtttatttccccctcctccccccccccccccctttttttttatttagtttttttatttttcctactctctccctcccttattgtatgttatttattgtagacccttttttttttaattatttttttttctattataattttatatatttttatactttacaatgttttcttttcaattcttttatttcgttcctttttataatttatttttcaaagcccccccttttttt

SEQ ID NO: 6340 - DNA, 323 bp, Bacillus thuringiensis
cgtgatcgattcagaaccacattcaaatacaacgccattcgtgactaataactgcacaaaacgcaacactgtggccttttaaataattagaccgcgaaaaccactatcatcgaaaatacccatatcccacataccttaccaaaatttcattacttgccgtgaaacgttgaacacataaaaaaatcgccccttcaaataacggacaatttcaattatcacaaaaccaccctaaccgcagctaaaaattcctaccacctaattaacatcaacggctcagcaccgtcttctcccctttgaataaaattcattccaaaaaagatgct

SEQ ID NO: 6341 - DNA, 131 bp, Bacillus thuringiensis
caaccgaagtacaaccccagaaacaaggaatcctaggggggaatataagaccggaagcgcgggaccaaccacctgaaacattaacagaagcacgcaacggcaacagacaaacaaccacagaagcgcggaca

SEQ ID NO: 6342 - DNA, 283 bp, Bacillus thuringiensis
  unsure (1)...(283): unsure at all n locations
gaattcgtgataagactgcagttttaaatataagcagctagatgacggcaaaggcccgagaggagaaggcgaggatttgaggggcagaaccgggncccctaacaccgcgaaaacaaaagaaaacagcaaaaaaaccggcagaaagacagccggacacaaaaggagacgagagacaacgaagagaagcgcaccgcgcgaaagcgaccacaacaaggaaaacgacgcagccgaccgcgaggagaaagacgggacagccaggacgaaagacgggaaaaacgaaaaa

SEQ ID NO: 6343 - DNA, 276 bp, Bacillus thuringiensis
caatactgaatactcttgtctcttataccctaactagttttctaccggctctagattccatgaaggggccgatttaatttcctcctgggcgtgcatatcttgcaccgacgatgctaatactacaccctagccaaccaccctttgtgctaccaccgctacagtcactaccaaggcttatcggaatttgatatctcaggcacatctttctattcctatcacatactgctaagtcaactacttcaatacgaactccatgacttcacgcctgcacttcat

SEQ ID NO: 6344 - DNA, 203 bp, Bacillus thuringiensis
catggatctttttttcccagacgaactaggtgccctacagaggcggtcctcacgtatgtgtggcacttaccgggcctacttatatcatgatgagacaattgattcaccaaaaaccggtacacggacatatcctcctggttaggcatgaactgctcatattgtctcatgcagattgcctgcccagaaacctcaaagaaccttac

SEQ ID NO: 6345 - DNA, 247 bp, Bacillus thuringiensis
agcagatatgatgagctgtttgcggctcatgatgtaatcgggctgctattagcggcggttggtgtggagcctcctcagctggtggaaaattgctgcattcatcaacagctgcttcggaagatgctggaaccaccatataagctcaagatgttgtattacaacaactgtctcaaaatatataacactttcatcgttgggcgcgaaatcatatgcgtcatatatcctctttgggcgacaactgtgtaca

SEQ ID NO: 6346 - DNA, 292 bp, Bacillus thuringiensis
ccctctttggggggctttaacgcaccatagttaatagtttctggtttcttaacttcaccggatgacccaagcagaaatgctggtcgcgcagtccgagaccacgaacacccacaggtaagagacggccctaatcgtgcagccagcgctggtgtaacgcgcaggcgtgcccaaaatacacttgatccaaacaccgcactgacacacggaaacggctgatattatgaccaatcgggctcttacgcacgccgagatcattgcaggccaaggcgaacctaccagccgcagaccaacg

SEQ ID NO: 6347 - DNA, 359 bp, Bacillus thuringiensis
gttcgcaccgacgatcccagacggtttgtggatgttttttagtcaatctgaacaggccatatctaggaggctctcacggtcgattgcaaacgctaagtggattctaagatccgccgtttgtccattatcagaatatgtcatgggatgaacgtatgagttccatacgttgacagtatgcgctagcgatatgggggcactgcaaacttgtagtgcacctgttactacatctaatgggttgcctgtatgcggtaagtgcgataataaacgctgtattgacgatcgaatgtattgcactgcttgctacatttgaactattgatatgccgctggtcagcagcctatcgatgtgcatacatatta

SEQ ID NO: 6348 - DNA, 469 bp, Bacillus thuringiensis
aagggtgggatgctggtcatctggtgattgcactattggggtacatcaagctgtgtctcagcagcggtaggctgcttgtgagcgatgactggggggtacattgtaccaggatgcgcacctttcaggtttatgctacgtggcgcgggtgttaatccgtattgacaggtttcttaaggaaggaggttgccgaatacactatggcaataatgaatggaatcaaagaagatgtgctaggtaatggaacgtgagttcactatagagcactattaggttatgcatggatgctctttattgtaatatatggtgcgagtttagcggcggtagctgttattgaaccgtgaaacaggatcagcgaaacggacgaatctctgaggcgaccattcactggcggctggttatgcattaacgcttagtatgtaggaggttggatccttaatcggattctagaaggagatgcattccgatgatg

SEQ ID NO: 6349 - DNA, 228 bp, Bacillus thuringiensis
  unsure (1)...(228): unsure at all n locations
caggccgattattccagacggaactngcatctttctttttatgatttacacctgaacgggaactagcagtgccaaatgcagtatttcattacggggcgttccaattgggtgatttcggcgcccaaaacgaattatgtcattaggtagcatttccacattattcggccaatgaaatttcccgcctataaaaattccaatttactaaatcaaggcttagcgtttagcttt

SEQ ID NO: 6350 - DNA, 325 bp, Bacillus thuringiensis
gatccggccggtacaccccaatcgaggaacttacatccgaactcagcgatgaataccgtgaaaaggataacgcgtggagaacacaaaccgattggacaagccacgcaattagagagaggaatgacagcgccagaccgcacgctcgggaaggcatcagacagcattgcaagccagcatgccgacggagaaagcggaaaagcaacaggactagaaggcaatgaagccgctgcacataaaagacacaaggcacgaaaacatggacccccaaccacaacggaaaacgaagaagcaatgcaaagaatccaagtaaagcaaacggagcatt

SEQ ID NO: 6351 - DNA, 372 bp, Bacillus thuringiensis
cttccaaccgtttttatcttcagggccgcaccatacaaatcgcgctggcactacaattgcgcctatcattaatcgaatgacgaaggaactcctccaaagcacgcgtacaacacgctgcggactgcgttcaaggaggacaagcccatgcgtacgagggaataaagcgcgtatcgcgcgaataagtcgacgcatagggacccagctgattcgtttactgtattcaagcactactctcaatcggatatataagttcattaggagcaatcggatattatatccgacaatgcagagaatagtgacatcgatggtggcgcatgtaggaaacactttggaacttctaaagcagaaagcctaaactgagcttcgactgta

SEQ ID NO: 6352 - DNA, 124 bp, Bacillus thuringiensis
agacttcagtcttctaccaccaaaaaattgtgaaacacctgtaatatatgcgacatactacacacaaaggaggggggtgctctattggatgtggaaaatcccgagcagcccaatatcaaaccta

SEQ ID NO: 6353 - DNA, 279 bp, Bacillus thuringiensis
cgcgtacgatcgatccagaacgcgtgatgtcctcggccaattctccatctataaaaatatgcttttttttactcctgttaccaatggatgagctaatacaagagccattctttgtctgctcacacgtgccatttccactgtttctttcaaatcgctgcacaaattcacatcaattgtccaatcggatacctggaaccttttaatagctttttgcaattcttatcaattctaaggaaatggtacttaatattcctctgtaactattgatctcgcagcctt

SEQ ID NO: 6354 - DNA, 155 bp, Bacillus thuringiensis
gcaaaaagccaacaaaaggccaagaaccgaaaaaaggccgcgccgctggcgcaaccacaaaggcaccgaccccccgacaagcaacacaaaaaacgacgctcaagacagaggaggccaaacccgaccaggactctaaagaaaccaagcgaaacccc

SEQ ID NO: 6355 - DNA, 144 bp, Bacillus thuringiensis
aaggctcgaaagcttgctacaaatacatataccgaacaaagctcattaccgaggacaaccccacatcgcggggggccctacaaaagcccacccggaatgacaaccgaaccccaaatgcctcaaaatactgacaaacaaaacgat

SEQ ID NO: 6356 - DNA, 169 bp, Bacillus thuringiensis
ccgaagtggatacacccacaaccacagaaaaacatctaggggcaaaacgaagagaaaccgggggctagcacacgcgagccaaggggcaacaaaacgacacgacccgtacaaaggccaccgagaacacatccaaccacaggaaccgacggcatcacaaggcgcagagcca

SEQ ID NO: 6357 - DNA, 351 bp, Bacillus thuringiensis
  unsure (1)...(351): unsure at all n locations
aacaaagggcaaagcacnananaagacgaacaaaacaaacaccagcgcagcggaccaaagcgccagaccccacagaacaggcagaccccgaaaacgaaacacaacaccaccgaacaccccagaacagaacccgcaccacgcaccgcccggacaaacccccccaaacacacaccaagcaacccaacacgcaaaaaacgaacaganacaccaacaacacggagacgcaacaaacgcaacacaaccccagacacgaaccagcacaaacaccacgagcaagccccccgacaacaccacccaaaaacacaagcaacaacccgaacccccaacccgaagacaaacccccaaaccacc

SEQ ID NO: 6358 - DNA, 181 bp, Bacillus thuringiensis
caagaaagacgacaaaaaaaacccccacaaccgcagccaaacccacaaggacaccagcgccccacgacccaagcaaagaacaaaccgcaaaacaccaagacccacacgacaagaagggagcaaaaaccccaccgaaacaagagaccaccaaaacaaaaaaaacaagcacgcaacaaaaaac

SEQ ID NO: 6359 - DNA, 154 bp, Bacillus thuringiensis
  unsure (1)...(154): unsure at all n locations
aaggaanngacccgccncccagcaaaaacaaanacacnaacaanaaaaacaaggagcgaggcaccaagaaaaaaaacggaaccacgccacgaagcacccaccccaacacaggaggcacacaaacacaagcggacacgcaggagcgaaaaaagac

SEQ ID NO: 6360 - DNA, 128 bp, Bacillus thuringiensis
ctcctgcataaacaacgttcttctttagcaccaacatcagttacaggagcagggatttgcagatagtacaaacgccggaataccatcactatacctcttttggaactatattttttccggactttcta

SEQ ID NO: 6361 - DNA, 295 bp, Bacillus thuringiensis
ccccagcaaaaaaaaacaggagaagggcattttaagggaaaacccgggctaccccaccaaaaaaaaagaacaaacaaaacgcacataaaaatagagaagcacccggaaccgcaaacagaaagaagcacacagggccagaacaaggacacagccaaacgcgcacagcagacaaaggagaaaacgcaagccgccgcaccaaagaaacctgcaaaagacgcaacaacaaccgacaaagagaccccaaaaagcacaaccaccgacaccgaacgcaaacgagaaacccgcaccacccgaa

SEQ ID NO: 6362 - DNA, 432 bp, Bacillus thuringiensis
taacctcgttttttttacccccgttaaaagaacttattttgccgatttttggacaaaccggccggggttgattgggggttggaaaaatataacccttcccccaaaatgggggggccccctttttatagggaccaaaacctttttctcccggacaattaaaaccggaaatgggatttttttccctcgctttatttataaaaggggacggttttggaattatggggggggaaaaccggggctttctctttaagggggctttgtaaacttttaaaatccccttaaccggttttggggggagacccaaaattttttattaccaattggacaagggggggcgggccaaagggggaggcaccccacctggaaccattgggcaaggaccggcccctgaaccattcccacttttaattcctagcccaatttttcttggcc

SEQ ID NO: 6363 - DNA, 149 bp, Bacillus thuringiensis
  unsure (1)...(149): unsure at all n locations
gagatccgtaaaaaccactgaataacccgatcttgaaatancagctatatagaaaccatcaaataagagaggaatatacaactgtggaacgcctacacccaaatcacgaactgtaaaaatgaggccattacatactgaatcaaccacaa

SEQ ID NO: 6364 - DNA, 200 bp, Bacillus thuringiensis
gcggctcaccaatcattaaacctggctcgcctgatgcctcaatggagtgcatctacgcccgtggagcggcgagtggtatatggggcgccacgccacaaactagatcacggactcgctgagctcgggctatgtcctaacgccagcgctaaaacgataagcggaagccgcaattcagtttaccacggaacaaggggatcacc

SEQ ID NO: 6365 - DNA, 359 bp, Bacillus thuringiensis
gccgcgattcgatcggatccagatccaggagatcgtgatcacccttgaagcacagacgactagaagactttttcttccatccccatatccctatgccctgggatccttagataatgatcggcctccctgcactaatgtctgatcggaccattcaccaatctgtattcgctatcacacacaaacctacatttggaacaccaagatgagcgacatcattgacagtggcatggagatgaccgaatgcgaactccacaaggacaggagcagtccattctctaacaccaaagcatatcggcataggagacaacagctcgatgagaccttccacgtcacggggtggacactctcctgccgataca

SEQ ID NO: 6366 - DNA, 135 bp, Bacillus thuringiensis
gccgcgattcgttcggatccgatccggagatcgagatgattctatgatcacacgcttcctgcaggatttctttcttagcaagcacctttaatatacaaagaagcgtctgggcgaaacgtcctgtttaatcgggca

SEQ ID NO: 6367 - DNA, 247 bp, Bacillus thuringiensis
ttaaacgatcatataccccccagggcccacacgtaccttgagggggcctttttaagaatcattgccgttgtttacagccggtcagcgcaccgagccgggcacccgttatacttaggcgttccaaggtcgccatgtccagagctgacggactttgaaatccctatcaaatgactatctctctttcccagacacaaaaaaatcggccctggcttaaccacggatttcgtatataacataatcgatcttg

SEQ ID NO: 6368 - DNA, 302 bp, Bacillus thuringiensis
gtgcgtctactcccagagcaaccacacaagtttttttagataccacgggagtcaccccacgagggggtatccttgagtgctccttgggcatcaagccaaggactacttactaaagttggtccgcagtggttatgccaagctgttgacaaggtggatactcatgcaatccgaggagatcattctgatcctgacacagaacgcaccatatcacgacaacgggcaaggcgcctcacttgcttatatgctaatgacacacgtgtcccatgaatgaattgtataataaaacggattagctgcctggt

SEQ ID NO: 6369 - DNA, 404 bp, Bacillus thuringiensis
ggaatagtttttggagaacaagaataaccttatcgaagggggggtctttggcagaccattgttgatttaacaaaagtgggaggagacggtgagaaacgcctgctgaggagcatacggaagttgcttgtgaacgtgctcggaatgttgataggagacgcctttgactattctggcaaggttgtacaaagccagattgagagtctgcgccttcatagagcgttagaagaaattaagatggacggtgtttattaagccaccctcgaaattgaagcggccaatccatgccgcatagtgaagcacacgtatcatactagaggcgcgctgatgaatagccacctatgtagagcgattggtacatccggctaaatggctttagatcgcaaatgtatgggcagaacctaaaa

SEQ ID NO: 6370 - DNA, 282 bp, Bacillus thuringiensis
cccgagattgagacgacacatacaattactatagcgacacgattttgattacccgttatacgcccggtgagagggatggtgtcctatacgtccacatctttacatgctggcggcacacaagcctttactaactattatacaccagattagcggtatagattatttcaatccatcactcttacaaaactatatctctgcgccatacactttctgatccagacaatactacgacgggtccaatatcacccattgaacaagcgtgttaaagcgctctacaaggaa

SEQ ID NO: 6371 - DNA, 361 bp, Bacillus thuringiensis
ctactgcggtgctggtatagccgctcaccagcgagactatgaggggttcactagacggggcatggtgctatagtctctaggggagctcgctatatcggcctggctgtagagcctaggcacgatccatccgaaaaatggacccggtacgttactaggatagggcatgcattggaacggcgcaacccctatagagagacgtagtggaggctggagtactcacgggattggctgtgctctctgcacagaagggtatcgctcacttatccgaacagcttacgagcccgaaccataaagggttgtctggggggaggctatggcgggacggaacttcaaaaaagcgcggggcggtcactgccccatg

SEQ ID NO: 6372 - DNA, 448 bp, Bacillus thuringiensis
tgccgagacgcgtttcgatccaatccagaagacgggatcggctggttaagaactacaaggcgtataccttggctttgaacctcggggatacacgtgacgcgggggcgaggcttgaacttgtcttaccagacggtggaaaactccgcacggtggcgaaagtctgcacgaagctatattccatcagactgaccgcgggtctcatctagcacataacgtcctctagtaaaaactagggaacccatttctgcaattggacttaaggccggaacacgaaacacatggccggcaccctatgtatagtcaagctgaaactgcctcgcagatctactaatcgtgcacaccgagcgctggcgtagcactggaaatactggcacgcccaccggcagctgaacgatgatccttttaacgtaacaaggccacgttcccttggcttcattgcaaaaactca

SEQ ID NO: 6373 - DNA, 133 bp, Bacillus thuringiensis
  unsure (1)...(133): unsure at all n locations
agcaaaaagaagaagagggcggaacancacacccaancgaaacagaagaagagggggaaaaggcacaagaaaggcncaacacacaagcagacgagcaagaagccgaaaaaaaagcacagaaaagacggacgac

SEQ ID NO: 6374 - DNA, 202 bp, Bacillus thuringiensis
  unsure (1)...(202): unsure at all n locations
acgtttaatttagaacccaataaatagctaccncgcccaaaagacgcgaaacagganctttttaggacaaaaggcgtgccacacccgcaccggcaaaaacagcaacaagcgccccnacacaaancgncacaacacaaagagcaggacgaagcacgcagccagaggacaaaagnccaaccacaccaacagcacccaaggaagg

SEQ ID NO: 6375 - DNA, 334 bp, Bacillus thuringiensis
gctgtgtgcacctttattgcgcggagacaactggagtcactgaagagggcaattattccacggggtggtagatttgagagttacttcattatgcaaggcgaacagaagcaccaacgggtagctggattacaatgttcgcccgctactccactgcaattgtggttctctcagggggaaacacgttcttaagtgcaccgatcactttgcagggagctacattctcggagtgcatcaatagaggtctaatgtggatcaaaagcacaaggacatggccgtttcaaaaaacgattcatcacggactgtatggacttcacgggggggcatgaaatcttta

SEQ ID NO: 6376 - DNA, 228 bp, Bacillus thuringiensis
aaaaagggagaaaaacacgaagcaacaccaacaccaaagacaagaaacaacgagaccgcagacaacacgacaccaacagccaccgcacccaacagcgcaacccacccccacaacacctcaactgaccaaagaacaaccgaaccccaaaaagcacaacgcgaaccaaaacaccacaaacacggcgacccccagaaacacacaaaaacaccgcacccacaaaagaaaaca

SEQ ID NO: 6377 - DNA, 152 bp, Bacillus thuringiensis
gcgactcgtatcggatcgcaaccagaagacgtgattacgcgcgagaccacgggcaacccgagcatcttctttcacaagagcagcaggaaacaccgcggaagggaccctcccgccagccggaacccgcacaccaggaaagcgccaatcaaccg

SEQ ID NO: 6378 - DNA, 534 bp, Bacillus thuringiensis
gcgactcgttcgtatccagatcctgaagacgtgattgacttcaacatcaccaacttcttgaacactttcttcataataatgtagcttgaaacaccatgtgcggattgatctacaccagccgtgttgttctaaagcccatattgttctcgcaccgataccggctctggcaatgacagttcttctaccgctttttctgattatacactcttggtacacgtcgctacaactggcgccatttggacctgcgctgcataatcagacgtggcagatgatgcacttgactactccccaacctcagagagtaccatatatgcacgtgtatattactggaccattgctacaccattatcagcttactgcactgagactcaacccgcatacatgatacctgttatagtttcgcctatatcaacgagcgtatcccgcatctaatctctcgtgagtggcgcggatagagcaagcatacgtcattagaaactgtcttgcacttaatgagccagagcatggtcccctctcagcactagacattgcatg

SEQ ID NO: 6379 - DNA, 409 bp, Bacillus thuringiensis
ttcctttcgggttaataatctcatgagcatcttatgttctgccagcggccttatgcgccttttgaggcatgacaggggctaatgcggtgccttagaaaagagggtgatgggctcgcgttttccgagggaggcgagcttcttcacctggtgcataatctgcaggacaatatgtaggtgaaataaattcggctggaatcgttaaataatttgctgcacagacttttgtatgtactggatgaggcaggttgtatacgcacgttaagcaagcgctgatgatagtgcgattcttgaatcacttgagatgcgccagttgcatactcctgcgaatcaatcataaacggcgtgatgctacatgtcggcctgtgcttcatatattgataccaatcctagatgaatattcactggcctg

SEQ ID NO: 6380 - DNA, 188 bp, Bacillus thuringiensis
gcgcaggggcgagaagaagagagacaaaaatagagaaaaggaacaggtttttaaaaaaaggagggggaccagaacaaaggggggggaaaaagagaaaaaagggggggagaaaaaaaaaagaagggagaataagaaagaaaaaggaaagaccaaaaagaggagaaaaaaaaggaaagaaagaaaaaaag

SEQ ID NO: 6381 - DNA, 320 bp, Bacillus thuringiensis
  unsure (1)...(320): unsure at all n locations
ccacgaccaaacggaagngagggggcattttgaggaagaagggggacaacaccacaaaacggnanancacgcngncaaccaaacagacaaacacaaagaaaacgaaccgccgcccgagaaccacaaagacagggcaaagcaaccgcccncnaaccgggacaccgaagcagacgaagcanancacacgncaccacgaaggaggaaccanccacacaangaaacnggaagccnagaaacgnnaannacancnancaggaaagaaaaagagcggcacgcaagagagggaacggagagagaaacagaacacccaacgggggaac

SEQ ID NO: 6382 - DNA, 223 bp, Bacillus thuringiensis
gatgccataaaccccttgcttcgagcgcactttttttcttgccctgggatgaaaaacccggggaaggtaaccatgcaatatcctgtgccagcacaccaggagaaacgatctcttctactaagacgacaggatggtcagcatggtaatgagccatgctgttgattacaatatctgactgcaccaaggcattgccaatcccaacatgatatggctgaaacttggc

SEQ ID NO: 6383 - DNA, 393 bp, Bacillus thuringiensis
cccggcgctcgaggcgcgtggccgcaaactcatattgaggccattatgttcaaagggcagccatgatgatatgagggggcagaatgaaacaccgtttccgcgtggattccctggcaatacgcccagaatggaaagggaacacagagcgctctaatagtcagactccggacccgggaggtgcatcaccaactgataatgcctcgcgagcaaaagcactcgctcctgcgaaaaaaggcggaaaaaaacgatacgaacaagatgtaccgactctttaaggatatgactaaattgaaaatccacaatttaaccggactagcaagcgatttgagtcccccagaaccctttgaaacctaaccatcctttaatcggaaaaaatacaagggctatgtggag

SEQ ID NO: 6384 - DNA, 334 bp, Bacillus thuringiensis
aacgggcctatctatcgagcgggggttcccaaataccccaggggggccatgagagcaaaagtctgtgtttatccccgccgctaatagcaggcaaaacaacagcctacctacagggtccagaccggtacgcgcgttcctccggcaagccatccacatcagctgatacaggataaacgcgaagtgagccgctggagagggacgggtgacacactgcgcaaccttgaaaaccgcgctgcatgcatgtagatggaaggcacgccgaaagaaagcatgccaatcctcaacagcgtcgaaacaaccaagtgccgcgcaggacggcctttggtgggcaaaa

SEQ ID NO: 6385 - DNA, 129 bp, Bacillus thuringiensis
ccacaggggtccaaacccctaccaaaacacaacaaggaggaacatttaaaaaggaaacccgggaccccccaaaaccaggaacgacaaaacaaaacccacgccacaccaccagacgagcccacggacaca

SEQ ID NO: 6386 - DNA, 172 bp, Bacillus thuringiensis
  unsure (1)...(172): unsure at all n locations
cttccccaacgaaaaggngccggngcagcanacccaaacaccncccaccgggaaaccaccgaaaaccacgacaccaaaaaaacaaacgccgacgagaagagccgacaacagcccccaccaaccggaaccaacgacccaagcaacgcccccgagcccgccgagaaaaacgaac

SEQ ID NO: 6387 - DNA, 475 bp, Bacillus thuringiensis
  unsure (1)...(475): unsure at all n locations
cccattggttaggcctggaaaaccggggttaataatccttgtaccgaaaggttggtagcccaagggccaaattgtaaaaaacattaagctaagttattttgagcaaagaatacggctggaaaaagtccgtaaaagctggtgcaatttccgcatgcgaaaagcaaattcctttagctgaaaagtatgaaaaagcggcggttgaaaaaagtgagtgggattntgctcaaatcaagaaatttttctataccaacgcctattattagntatctcatacanaggtccgggcgccaatcggatttaatgtatttaggcagagtaaataaaaaaaagctacttgaaaatattatttcaaggtaagcttttnttatggtaaatcagaaaggtaaggaaatatagaagaggctacacagggcatctatccgctaatgatatatgcgaggtctgtaaaaatattcattcataagaaaaacacccc

SEQ ID NO: 6388 - DNA, 303 bp, Bacillus thuringiensis
ggctcgagacgcgtggccacatacacagactccagaaactgtctcacgcattaaagagagtgatccacacgagtcacatataaaacatatctgcggtgaaggaaagagaaacgcacacgcgtggcacatgatatatcgagagtgagggggtatgcgcataactcaactcgagaagagaggggtagtgagagcacaactcatagctctaggggaggatgtgctcgctctacacgtggactcacacctcttagaagaagagatctcgccgctagtgaacactgcaccacagaaagagtgtggaga

SEQ ID NO: 6389 - DNA, 151 bp, Bacillus thuringiensis
attaacagacacactctctagtgctttttagaggcggaaaaatatcgggaggggtgactgagaaaactcaaccccatacacacactctcgtgcacaaaagagcgatcattgcgcagagggactctcagggtgatattatacccccacagga

SEQ ID NO: 6390 - DNA, 350 bp, Bacillus thuringiensis
  unsure (1)...(350): unsure at all n locations
tattttttatcgccccaggataaaaacccagggaaccaaccccagcagggagcaattttaagggnaaaggcggccatacaacaccaggagcgaccacgaacagaacccccacacccacagcggcaccgacaagggcaccagcgccaccagaaccaaacacagcaaaacccgcaaaacaccaggacgacaacgacacgaacagaagaacaacaacagcgagacaaggggacccgaacacagaaaaaacaggcaccctacaaaacacaacagcgacaacaggcagggcaccaaccccagccagggcacccacacgcgaaggagcacggagcaacgcaaacaccgagagccca

SEQ ID NO: 6391 - DNA, 308 bp, Bacillus thuringiensis
cccactctactttttttcgtgtatacgccgcaaaatgagatgttttatatcaagaggcagcacgggtcgcgcataaagggggtgcacacctctcacgcgcacagagtagctctctatatcaacgcgctcgagataaaattatatcaccacattcacgcgccccgctatagggggagtggcgcgaatacgcgtatagagcgcagagagtggtgtgatcacaaactcttggggaagagaaaaaaatatggggacacgctcctctccacccgcatatatccccggggccatcacccgcgcgaaaaaaaaaa

SEQ ID NO: 6392 - DNA, 139 bp, Bacillus thuringiensis
  unsure (1)...(139): unsure at all n locations
gggaaccacaaaaaggcaccacggcacgcccgaaagaagagcaaaccaaagacggggaaacagccccaacaagccgcaaaaggccacgggggacaaggcagaacccgaaacgacgcccccnggaacacaagcaaaaggc

SEQ ID NO: 6393 - DNA, 123 bp, Bacillus thuringiensis
aacaaaacgtctcttaccagcgtataaggcatacgtaattgcggcataccacgagaatagggcgcagtgtcatataaagggaaaaaaatgacgagactgactggctctaaaaagaagcggcac

SEQ ID NO: 6394 - DNA, 189 bp, Bacillus thuringiensis
gattcagtcccagcaaagccccagatcaccacagagacttatgacactccatctatgacatccgaggcggcgcttttgacggcataaccctctagtcaacagcgtgcgaacgaccatccccatataaccacgtacttcactgaaaacctcgactagagcccccaacccggaagtagcacaccccaacca

SEQ ID NO: 6395 - DNA, 338 bp, Bacillus thuringiensis
agaccgcagggatccacccccaaccaaacaaaaccaagggtgagaaaaaagaagagaaacgggggacccccccacaccaggcaagacgaaacaaaacacaacgacccggccagaggggaccgagaacacgcccaaccccacggacagaaggcaacacaaggcgcagagccaacacgcccacaagggcaggactcaccacatgccagacccgacactgaaagacgaaaaaaccgggacaacatgaaagaaagaggagccgcggggaccaaccccgcaagagaccgccaccgcgaaagggaacaccggccgacacgcacgggacatggagagcgaccaag

SEQ ID NO: 6396 - DNA, 319 bp, Bacillus thuringiensis
gaatcagacgcaggaaaggcaccttacaccgtagtgttataaggtgctgcatcacagacatccgatgctacacttgcgaaagcgaattcatatgctaaacagggtgcagaatggtactgtactaataatcgcgtactacactgaaggctagactagagttccaagcccagatgacgtacacgcatccagtgggaagccaattgatgcggtttcatatgaattgggctggcttatgctcaggcgatgaggatgggttcgcggataacggaatatactaggcggcgagaccaaatgttcaaaaccatatctatcaaagcta

SEQ ID NO: 6397 - DNA, 121 bp, Bacillus thuringiensis
aatggtgacgaacatataggatagacatggaaacttgctgagtctagctcgaggagacatatttgggagccctggcttgcgaagggtcactaatataattaccataattggtgggtgaata

SEQ ID NO: 6398 - DNA, 246 bp, Bacillus thuringiensis
taacaaaaaacggatagaacgcacgacgaaaaacacacaaggaggtttgattaaaaacaaatgggggagcaacccaatcccccacaacaggagaagaaaaacaagccaacaagcgaaatgaaaaaaaaaatccaaaacactaaaagataccataaagacacacgcaccacaagaaacaaacaaaaaaacgaaaaaagaacaaacccgcaaacaacgaagaacaaaccaaaaaaaagacaagaaaaa

SEQ ID NO: 6399 - DNA, 436 bp, Bacillus thuringiensis
tcgtgatggggacgacagaagctattcaattaacgctacctttttttgcttcaagggatgctagattccattgtgtgtatgttaattcctaagcaacagatgctctcaccacaaagagtattaacggccgaaccttatcgacctcaccgaacttataggggtgtctagcatctgctgcggctgacttgcgtgtaaaggtatatgttgcactatattttaggaatgcactatcatgatgtgcttccaatggctgcatatcatattgagcgctgtatcactcccattctgagccaggacatggatgttcgttgttcactactgtatctggacctacataaggacccgcatctggaaacgcatgagatgatgcacaaggtgcatccgcacttacctactgttggaacgcactctattgcccttgggcagcgaacacata

SEQ ID NO: 6400 - DNA, 103 bp, Bacillus thuringiensis
gaggcgtaatttacttgttgtccataccataccgacaccgggctggcttacgacttttacagtgctatatacaaacagtgtgctgtaggcaaggactcccata

SEQ ID NO: 6401 - DNA, 130 bp, Bacillus thuringiensis
agttttccaacagaacaggatttgtcttgagcaacagacctagaactgacaggtgtttctcttacgatgcaacgcacgataattctaccagccactgttgtctatccaacacgaaaaagagcgactcata

SEQ ID NO: 6402 - DNA, 304 bp, Bacillus thuringiensis
gaattcgtgataaaaatgggtttttcatttgggcccacaggtttaggtcgaacgccggacagatagatgtgagttttttgggggataaaccggtttttccactaacaggaataaattagaatagggcttagaaagctgcactggttaagcaggggatgatttgctatgaaagaaacgtaagataagtttatagatagatacaaatcggagaaatgggggagcgtcatgcgacagtactgaaataaaccacttggtggggaggcatttccaaagaattcacaaggaaagggtgtgtatttgaatg

SEQ ID NO: 6403 - DNA, 349 bp, Bacillus thuringiensis
ttcgtgatagaagggcagggactcttagatctgcgcagattctcataaaaagacctcctgggctgccagagatgggtgggagggaagatggaagtgttagcagccatttatccctattctctatgtccattattttcttctattgaataacccttttcttttttaggtcctgttcttactgggcaaattgcttttttttggtttttattgaatctcttttttcatgttctctcctgaaaaacatctttttttttttttttgtttggtttttccttattatttttcattttcaattttttcgctttttaataaatcgtactgtgaaaaaatagaaatttaataaccgttt

SEQ ID NO: 6404 - DNA, 194 bp, Bacillus thuringiensis
agtgattttattaatagaggttgacgagatacaccgtgagggattactgaagaccggacacgtattaacacacgatgcaggtggtgggcgattaccggagtcatattgaacatattggggtttccagctggaccacttggaactacaaagggaccgaagtttgtccttaggataaaacatacacccggcttaag

SEQ ID NO: 6405 - DNA, 161 bp, Bacillus thuringiensis
agacgcgagacctgtcgtgcagacccgaattcgtgatggttctgatgccatatgcgttggacatattttctttctttaacgccctcatatcctttactgcagatacgtagattggaaagacgaacttcctaggtgatgagactaattggctattgagacag

SEQ ID NO: 6406 - DNA, 214 bp, Bacillus thuringiensis
acaggcttcattcgagcgcaaagatggatgaaagagattaagctgggggagccaggctggccgcagtcccaccgtgaatatgcgggaacggcatcaaccatccaggggatctgccgcgactatcatcagatgtatgggaaccacccgttgtcacgccctgggtgtatgatcaactttaaacgcacggatgcatgttatgacaacttcatgaagg

SEQ ID NO: 6407 - DNA, 306 bp, Bacillus thuringiensis
ggctcgcgaggcttggaatccaaatacaggggagctttctttttgctttcctgtgagcaagaatgcctgcttaaggccatatacccaatttcggtatcgtagctgacgttcttccacaggctccacccccctgacctgcttcagcttggacgctgaggtcagaactggctatacaccgctgaccattgtttttgcactaatgttgctgcacctatctttgtctatctcctttcatagcattcattttttaggctcttttgctatgccaaatcgttggcattttgatgatcacagctcaattcaatt

SEQ ID NO: 6408 - DNA, 226 bp, Bacillus thuringiensis
cgagacagagcaaaaacacgccgagggagaggcccgcagaccccaaaccagagcagaaaacgcgcacccgcgcacgcaacggccgccacccccacaagggccggggacaaacccgaaaccaagccaagagcaacaccaccacccaaaccaccaaaacaaacgaggaggggaggagcacgcccaaacacgccccgcacccgccacccacaccaaaaaaacaaaaaaa

SEQ ID NO: 6409 - DNA, 297 bp, Bacillus thuringiensis
tgcactgccttttataacccgcatgagcacaacgctctgaggggggtcaagttcgtcagaggccggaatacgatgtccgcacatactttagacgatacactgagcaaagaacagactagcttcttacatagaacaggtgatataccgtcaaacggccaagataattgcaattttatatagatgaaattccacggacaggcaagaatgaccttatataactttgggaaatctaacgatacctactatgacttacggaggacatacgatgaacgacccattagatttaagtaaatatag

SEQ ID NO: 6410 - DNA, 353 bp, Bacillus thuringiensis
agcgaccttgtcaggcctagccattgggtcttctcccacttctcgtacgtcgcgctggcagtctggactgctagcgccggagccgtagggaggacaaaaagaaaccccggtgcgcaggcgcacgacggggtaataaatcatctcggcgttcacctgcgcgggccatccatcgctccggatgcttggcgggaaaccccgaccagcggtctacggcaactcatacagaatagctggctgtaggtggagtgccaaattaccggataagacagctccaatcgccccaataacatgtccatctgtggatgcgcccagaaactccccagtgtgatgacgccatgaccaccatggtcacg

SEQ ID NO: 6411 - DNA, 321 bp, Bacillus thuringiensis
tgatccccagttataaattgtggttaaatcagcttaattaaggaatcaataggtccgaaaatcgggctaaattctattatttaatcaataagaatagtaccgagtatagaggctgatgtgttcgatgggcatttgtgaacagagaggtgcactacttaaggtagaccgacggcatttttcgtgaaagcggtgagatcagcccgccagttaatactttaaggaccagtaacatgaggcaatctcatcttaatcggtttttatgaagagattccattcggaaggcggctattaaggtcttttagcgctgtaactggtgccccc

SEQ ID NO: 6412 - DNA, 445 bp, Bacillus thuringiensis
tgatggcttacgaatttcactgtagtacccccagtaaatcatgatcattctggagattcttatatcaacgggggggaattctaaacactctttgtactagtaaaccacaaatcattcgatattatacacaattacttagatttaatgaatgagagaagagtccatgtattattaacgcgggcgcttgtgcaaaccattcataactacataccgctattggtcggtcagaacgacccgcatgtcgaacttcaggggacgctaagaaggctggtgggggtcgatctagtaatcagcgggggctgacaccccactgatacgggctacactttatatcatgaaaacgtggatattacttatgccaatcgtggcgagtgtgactaaactgctgaatatcatctatataacgactcgcatcatatacatcacacaccggaggatgtgcttg

SEQ ID NO: 6413 - DNA, 126 bp, Bacillus thuringiensis
atgagttgccatgcgaaagcaactccatccgaaccagatttattacgttcacatcgctccaccgcctgaggggggtttttaacaagacgtgcgtccttagaacaaccccttcggacatggtagctc

SEQ ID NO: 6414 - DNA, 180 bp, Bacillus thuringiensis
tttttttttggaaaaagaggttgcgctaatatagggggccatacccactcatctgttgcggctcatccaattacagggcggagccacatatacataaagggttggttctaccgcgtggagccgtttataaaatcacgcctgggaaaaaaaggggttcctttttaccgatatttcccataa

SEQ ID NO: 6415 - DNA, 311 bp, Bacillus thuringiensis
actaaaccttggttttattttccctactgcatgattttcctaagggattgtggactggccagtaacactaacatgctcccttcgggtggaggatttatggtttgaatactttacgctgcttaatggttggctgcgttttctctgcaattgcggtgcggttaagcgccatataagagcctacagctgtatgacgtaatttacccccattctttataactctttaaaactaacaacagtacgaataggcctgacatggtcgtaaatacattcgaggccgggactccctgggaatttataaggtccccctgcct

SEQ ID NO: 6416 - DNA, 115 bp, Bacillus thuringiensis
ggcgaggtttattttctaatcggaacattaccatataggggagggattattgcaatataagccattttttctgaaggtaaacgaccaatcgggtcagttaaaaccttacattatc

SEQ ID NO: 6417 - DNA, 108 bp, Bacillus thuringiensis
cccaaggcacactttggcttacaaccgagacgcggggtcgaacggacaggctggaccggcacacgctatgctaatgggcacaacgggagtgaaaccacacccggaacg

SEQ ID NO: 6418 - DNA, 258 bp, Bacillus thuringiensis
aggttggatgtggttttgcccgcgggcacgcacatccctcgcggggcttgaccaattattcgggcactccaattccgttctcaattcctgtcgtgcctcgaggtaggactttcgaagctttcgcctctgcaggtgacgttacccgactcgatagatgtagaccagccgttatcgctgggaaagcgccatgcacaaaagcgacgttcgtttttacgggacgcgtcagagcatttttatatgaaacatcagcctggacag

SEQ ID NO: 6419 - DNA, 382 bp, Bacillus thuringiensis
acaaacaacccaatcaggtcattttcagaggcattttaattgaacacactatcaccaaatgcaaactcgaatgtaacattgcattgggaaaaacgacgccataatctaacgatggccagaaaccgaaaaagacaaaataatgctctcacacgttttataaaaaagaaacacctccttaccattaccaaatgcttgttcataaattacaactgaattgcaatatgagataaataaagagttagcacaatatcaacaatcgtaccatacaataattccttccaaatgtgtaacataccatgatggtccttaattatttcgtaacacatcattaataccacaactgcgcctttttattacaaactatcaaaacggttcgcctaca

SEQ ID NO: 6420 - DNA, 159 bp, Bacillus thuringiensis
ggggtgattgtgctgatgtgctaatgcagtttaaaatgcatgttttatcattcaccacaagaaacgtatttatgggggcatgctacatagagcagggttgatccagctctctgtgtacgcgcagaacagggatattgacactgctcaaacagtgactcg

SEQ ID NO: 6421 - DNA, 133 bp, Bacillus thuringiensis
cctgccgttgtgatggagcacttgaattagcgcgttttatgcttccagacgccgagcggcctaaggcggtactacacatatgaggaggctcggtttatcgcaataattagacgtgagacgagatcatttacat

SEQ ID NO: 6422 - DNA, 348 bp, Bacillus thuringiensis
gaatacgggatcataattggctctccactatttactgatcttatttcacaggatattactatccagcgcaattcagaggttatctcatacaaataccgtacaacactctctattaatgttgtataagctatacgctattgacaatcaaattctcgccagctgtaaaaaacattccatgcgacaaagaggcctatatataaaccaaaccaagaataacctcttaacattctcacgttccatatggatacatagcccactacgcccatacccaactttactcattcactgaccataacaatagacgccgtttgtatcatataaacatgatttgggaaaaaagacaatcca

SEQ ID NO: 6423 - DNA, 246 bp, Bacillus thuringiensis
cgttctgcagtttatacgcagtattccgaactggttttttagaagtaattctgaaccgacggacaggggatgttttcatattagtagggttagtcagtcgtgagctagggcttgtatgcctagggcgttagaccgtggtacaacgatgaaaagttatgaccggatggacctcattactgatttaaaaggtaaaagggcaaacacacgcattcagagcgaatacacggatggtctataccttgggag

SEQ ID NO: 6424 - DNA, 356 bp, Bacillus thuringiensis
acccaccaacaaggaggtttaaaactgacgcccagaaaaaggagacaccccaggaaccgagcataggagttcctggaggaagagacagcattgcaattcactgagtagcggatagagcatcggaacagcgcccataccaagaggctggcctgcaggggttgcaggacatcacacacggagtcacaaaggagcgaggtagacgaagcgacctggaaaggagcggggtcaagggcaacaaccaagcagtcgaaaactagatctctcttgaatgaaccctgagtaccgcggaacacgagaaactccgtcggactcagggaggaccatcttccaaggccaaatactcccttgagagcgat

SEQ ID NO: 6425 - DNA, 323 bp, Bacillus thuringiensis
ggatgaagctgacttcacgctgcaaatgcatccagcactgtactagaaagaccccaacgcaccgcaccaaggggggggggtttaaaaagacccgggggctaataaaccaccgcctagacaaggcgaatacacacacgaactacgtgtccaaggatcggaacaagcctgaatgatcctgctgcgcctgcacagacaggtacagagggaccaagcataagacgctcaggtccgtaagacaaacttggaaaacctgcagaacagaaaccgatgagccgaggcactggatggtctagggaaagctgtgggactaccggattcagcca

SEQ ID NO: 6426 - DNA, 411 bp, Bacillus thuringiensis
catgcgtgatcctgcgggtgacatactcccacttcgaacgggagatttttcactccatacgctgaacggcctaatgggggactttacatatgaggttgcggggtttatagcacaactaagatgttggacacgatccttaacatggttaccgcgccgatcgtctatatctggccaagtacctctgttataagaacggcccgttgccagatccgccacctctgcaccggctacttactatgggtagaaatggtcaggcagctgcctcaggtcacgtattggaacaccgcacggactgtgagggaccttatgaaataaactctctcactcatggagcaccggacttgcaatataactaggcacccatacgggacaggccctactgggaaggcgccttgcccgaagattagtcga

SEQ ID NO: 6427 - DNA, 382 bp, Bacillus thuringiensis
aggtccgagataggagtgagggtatctaccagcacggattatgggcccgctattgaagaacgcgcacgcgggcgtctttaggcgaaaatccgtgggtgaaaccaaaggtccacgaagtgatccatcaccacatgcaaacgtgatggaggtggggcgccataaggtactaccaggtcacattatagcgcgccttggggtaggagagtacgcgcatcagcttaagaacgtgcaccagccaggaagggccaaaaagcgtgaggtgtgtctcaccaggtcgctggaacggatgacatggcataaagaatatatcaactgcagaagaaatacaccgttcttctgaagagctggcgaggaacgtaacctgtaatatttcgggagacct

SEQ ID NO: 6428 - DNA, 268 bp, Bacillus thuringiensis
tgctttctttcggctgcatagccccagggcccacattctgatataccgcaacgcagcgcaacatgcgggggggcatttacaaggcccattggcttagatacacccgctccgacagggcgactgcgaattcacacaatctgaccctgccttgtatcaagcctaattgatcctgctccgtctgctcatacattgcgcggagggaccaatcatactccgtctcgattactaagagatacatttgtcaactagcccatcagaaatcgaacat

SEQ ID NO: 6429 - DNA, 249 bp, Bacillus thuringiensis
cctgttagatgtgaccatccttgtacgataagaattttctactaataaatcggtcgcgactaaaacgagagatctacatagagggtggactgctttgtctatgttaaaaggtgtaagggtacgagcttgcgcattttcaactggtgatagggttacacggatcgaatttatttgttttcatagtgaacgtgcataaggatctatacgtgctaatccgagtgtgaatattgcgcagtactgtattatagc

SEQ ID NO: 6430 - DNA, 262 bp, Bacillus thuringiensis
caggctggagaggctggtctcatattcaaacaaacttttttctcttagcgccggggggaaaaaactggggacggtttaaactacgcgcacttccagggggggcaatcgtttaagaaaacacacgggatcccggaggggaacagggggcccgcctggggattcccgaaggtaacgcccctttctaaaaggacgtttaggggtatatgggcgtccccaactggtgaatcttacccagggggaaccacaccttaagccgattaaa

SEQ ID NO: 6431 - DNA, 134 bp, Bacillus thuringiensis
cgcgattttaaagagtaagacatgaaagagaaagagatttcataataccactgccaccaatataaggaggggggaactcggcataaatacaaggacctatcccaatataaagtaactgacttactgggaaagga

SEQ ID NO: 6432 - DNA, 256 bp, Bacillus thuringiensis
tagatgcagagaatttcgatgagatgaaggaatcgattaacgctgtggaacctcatgttggtttacttgaagtaaacttaccgagagtcgatggtttgtactgggggcgcgaaatgagtttagtaaaagcttgaccagattgaaatcataggatgtgcgtgcagatgagaggaaacaaatggtgagcaaaaggccagccacggaaagcggctcctggaaagacaacacgttcaacgtcagataaaggaaaagaatc

SEQ ID NO: 6433 - DNA, 455 bp, Bacillus thuringiensis
ggaaaatctaagctcactacatgaaataagtgattgatccggctgtctgtcatgtcaaatcgtgttatggggcataccgagaatgtccctttattgattcagatctacgatgctaaaggaacccctctgaatcagcttcgttggagaatctgcacattcagaagtgaatctctaggatcgtggccgacagacacatcactggagtcgcttgtgatgatagaatatgataacacgcggtgttgctggactaatgcctaaaaggtgcagctggggctagtgcatgatcgaaaaacacagaagagcggaagtgtgctggtcgatattcagccttacacactgctgtcataataacatacccttgacgttgtccggacggaacaatgggattgggttaccgctgcagctgaaaatgtaagatttggttactgaaccctgcaactatacgatctaatgaa

SEQ ID NO: 6434 - DNA, 415 bp, Bacillus thuringiensis
aggattaaattaatagcccgggatgcaggatcacgtctctgattaccagcatggacacatgctttctttgctacaaggctgtataccgcacacggggcctgtccccaaggatggcctaaagttcctccatcgaataggagtgcatatgcatgctaaaagagcgagacataagctaaggatatgacaaacgagaatccctgctgaagccactggctgaacaccggatatacgagaccgcatcttgagtgaaaaagatacctgcggatcgatcataaagaacgatacatggagcagaaatgaacacagcaaaaggtatgctacactgtgttcttgaagtacacatactgctgatgccgagaggatatcatgttcagccgattgacgcaagtctttagctagttcactgaactgccta

SEQ ID NO: 6435 - DNA, 270 bp, Bacillus thuringiensis
aaaataaaattgaaaaagaacttgatctaagcaagtctgaaatctcaaatgtaatttacaaacacccaattggcaacggcgccaaattgataataggattttcagacaattatcctaaaacaccaatcatgtcgtcgtagtattttaggttgtcaatacaaatgggtgtgatgctaacaatcaagatgtgatcagatgtcactaagtcaagccacgcaataacaggactgggtgtgttctagcagtcctcagtgatcaagcaggaaacag

SEQ ID NO: 6436 - DNA, 111 bp, Bacillus thuringiensis
aatccgcgatatatgaactcttactgaatatagccatgcttgagttgtcgccataacacgataggcacttgcggggaaataccatatatatgggacgcagaggggtgcctt

SEQ ID NO: 6437 - DNA, 470 bp, Bacillus thuringiensis
caaccgccctgctacaactgtgcagggactttttttttttctttataaccctacgctaggggaagacctacctgctgaaataccagtaccttcacaaaggctgcatagctaagtcgtgacacaatttaaataaccaaacccactacgttataatgaacgggtccatacttatccagacgaccgggaggccacgccaattgacgatgaacgagcatttgcacagtaatttgccacaaatccgacggattcgcctggtggcaaattatgaacacgcctaaccttgctagaccactgttatggcgaagaaagtaaattagtgtaagactaggcagatcaacagggaacactcgatactcgaatgtaaaccaaggcaatagtcatggacaggggcagacatagagagcaggccttgatattccaataacatactacccataccggtgaaagctcaactgaccgtggataactta

SEQ ID NO: 6438 - DNA, 119 bp, Bacillus thuringiensis
agacttttcattcttaacgcgctacacgcattctgggggtaggacaaatgaacacaccgtgtcgggcattgaccatgtggagaaaatgcagtgaacataccggaagcaagagataccac

SEQ ID NO: 6439 - DNA, 222 bp, Bacillus thuringiensis
cgcctgcttattctccgagtcatgtcacgcccgatgtagtgggtggtcgtacgtagcacataactataccaacttctgtgacagacgaaaaggggattgactataagagagggctgaacgccgtgagtaatgtgaattggcttgacacacacatgaggaccactaagcaataactgcggaatcgtaccctctgctgcattccatgctgttacaatgaaacgc

SEQ ID NO: 6440 - DNA, 319 bp, Bacillus thuringiensis
gtaatccagcctttgtaacttgggtactatcagtgacgaacggggatctttatttattcggagcacccgctgcgttagtactacaaaatatgagtcataattataaagcaacgcctgttattttaacgacagttgaagagagagttgatctaaagatagagccagtttatcaggcgatggtaagctccgaaggtgaagtcttacgagagagtatcttatcggttagaaaaaccagcatttatagataaggatgcgctctactacgtaaatccaatgcaaactgataaggcagtggtatagctaggcgcaaacgagtttg

SEQ ID NO: 6441 - DNA, 293 bp, Bacillus thuringiensis
cccttgccccatttttaaaaatagtaccacccacgggcagggacctctaaaaggtaaatggttaatcatctttttattaataccctggttggatcccaggaaataaaatggcggcggaacatgccttaagaggggggatacctggcctccttataaccacaaaaaatccagcaaattttttggtgagagaaatatgtggcgcctcctgtgaaaaacacatatacacctggggatataaaatcatgaatgaaggcatctttgcgctgtggtagatgagttgatcctgaggaaac

SEQ ID NO: 6442 - DNA, 328 bp, Bacillus thuringiensis
aaacaaccacgtttatatgccgactaaataaactatccacgggggcaatataaaataccagggcgtctagcgccaactgccctagaaccaacctgtgtcccccaaagccaaaaaggagcccctcgacctaaatccgatgacaaatccactgccgcaactgtactggccgtgcaagtaccatggtctaatgctttcgagcaacactcgttattgagtttttccaactggttacattcatacttagctaacgccctcatccatgacacctgctttcctagaatacgttcagcatatacccgagcatcgttgttaccagtcgatggcttat

SEQ ID NO: 6443 - DNA, 418 bp, Bacillus thuringiensis
tattaatgacattttatcctgtgtagatatgatgaggaaaggggaagttgttgatatacatgagcctattggctattttagaccgaatactgtacaaattgaaaaacagatgcgttctattgtaatgacaattgaagagtggcttgaatgaattatagatgcatataagagtgcgtaactaagctccgaacgtgagtataaagagagcgtatcttctagtttagaaaatgcgggattaatagataaggatgccataagaaatgctgcactatatcatgtttatacagacaggatctggataggtttacacatgatagatgctaatatgtgcgacagtgaatgatgctaatgtctatatagcaatcaacaattggacaaataatcactttatgcagcactttatgaatcatcgacatat

SEQ ID NO: 6444 - DNA, 275 bp, Bacillus thuringiensis
ccaaaaaggctatgttcccggctttggacattcgcacccggggtgttcattaaagtaatgggggggtgagaaacattcgataatccgcatttcgatctgcaaaccgatgaaaacagctatgaaggaaacttagtaagcttactgaaccattattagatacttgggaatctattgttcaccgctatattagccttataaaaaaaccgtttgctcatgtttaaagcaactggcgaggaatgtcaccaaactgatgggataccgcgatcaatcgccat

SEQ ID NO: 6445 - DNA, 543 bp, Bacillus thuringiensis
gctttcgtttgaacttctatcagcgccaaatcctgattcgattagtgagcggatggggcttttatttaagaacatgtgagattacattccaggtggaggacagttacttaattcacatcaccatcactaaacatttttgattgaccaggcctagaacaatagatgattgaaagaaacacctttacttggcataaacaacagatctgatcgatcaccaaagtcataaaaacattgacctttcatacatgaaactctatttcagtattacaacatcatcacagtaaaaaaatagccacaaaattggtccatggcacctttggatagattgaaatcatactggagttcacaaaaaaggtccacaaaaaagcaattgaacccggcatcacagaggattcaccgcataatgagtaactaaactagattcaagatacttgagtttgaaagctttgtatctagctaatgctctgcactgaaacctttaaactagaccacacttggatcattgaatacatgaagtaaaaaagacaacttcagcaatccaac

SEQ ID NO: 6446 - DNA, 437 bp, Bacillus thuringiensis
caaccgattctttacctgaagtttgaccatggcattgtatgttaatagaggcagttctatataaataaacttttaaaagtgaaaacactgatgactactagaataacattacacacagcggtatctttatacaaaaaacgtgcatggcagctgcgctatcccaatgcaagtacaatgaaccacatcatacgtacatacaggcagggaaaagatatgaacgaagaattaagtgagaaaatgattataaaaagttataagcagtatcaatgcacaccgatatcaataggagatcaggaaacgctaattaatcatattcaaacgacattacatgcagaatgctgaaactgatgtgatacagaggcagatgaggatatcggatacgattgtgtgactggaaaatacaacaataggagatttccatgagggaacaccctatt

SEQ ID NO: 6447 - DNA, 392 bp, Bacillus thuringiensis
attcaacttttccactgatggactttaaatggctttttgtaccccactccacataatgctatctttggggggttctttcaacatatcacgatggctcattgaggtctctaaatacgtgcatatctcatattgtgagattacataaacatattgtcacttactgtactactagatctacctgtgtatgaccacatgtattattaataccatgaaactcatccaaatctataaagacaaatgcaaacttgacactgttatgcataagagtattgaacttattcgcacaatgaaagcctatacagtaatcccggcaactggtcataggaagctaaatattctgaacgcattctgattaatacttgccttgcaacatatgtcgaaacactataaat

SEQ ID NO: 6448 - DNA, 341 bp, Bacillus thuringiensis
ccccgacgtggtgattttaccgaactttaatctagattaagtgaatggttctttcgactcagacctagctaaatcccggtgggggtataccgtaagatatgcgctaccaatagtaacatgaaactatgcgcatatcggtaggaaatcaatgagatgtgcgacaccgcatgtcaataaatggctcaaagcacactttcttcattgtaccatgttgcatcccttgaaagagtcatttatgacactccttggctgaagggggttcacacaatgtcatgcgaccacatatgcaactatccaattggatagattcatgagtcactgattgctcattattgcctttt

SEQ ID NO: 6449 - DNA, 388 bp, Bacillus thuringiensis
caagaccattttcttgctatgcaatagctgccggaactggggtgtgctttaggacaacgagcgtaaccacatcaccaattatagaaccaccccgtatctcaactgcagcatgcatagctccgcccttaacctatcgggagtgggccgagagcttgacgactgcagggtgatcgctctcgactgtgaaaaaaagaaatccaccatcataatcgcacatgatacggagcctatacatatagtaagaagcctgtggcggctaataagtgagctaccgtacattgaccgcgatgagctgacggtaatttttcgagtccggaaaccagtcgtgggagctgatcaaatgaagcgaacaccgcaccttggaggcgactttcgtattgagggcatt

SEQ ID NO: 6450 - DNA, 170 bp, Bacillus thuringiensis
ttatgatgatcctttacatttttttaaatgaatttgatgaatcccttaggggaatatggtgtctttttaatcgctgttatataaccgcctcaaaatatgctatctgtccactgttttctgctctttagtaaacgttactcagcttttaattagcctaaaatttgtaaagc

SEQ ID NO: 6451 - DNA, 331 bp, Bacillus thuringiensis
gctgagttatgttagaagatttcgattgttcgaactacatacgagaaaaccaaatgttatgtagatttttgaatacaagcattattgttggttcgattgatgtcctcaaatcagtcagaatattgctgtgttttgcttttgctgagtttattgagaaacaattattatgttattctcgagattaaaaaaaaaaagtcttaatagggaaccgcgaataatgattggtttcatagatgcacgaacacgtcaacagatgataattcagacgagttcgaaattattccttaactaaaccctccaataatcaaattttctgtttcgacgtggaata

SEQ ID NO: 6452 - DNA, 344 bp, Bacillus thuringiensis
aatttttggttagttttagcctattttggtagaaaatgggtataaattttgtctaaacactcctaatccatctctgactcttataattagccaaacgtgctatgctacgtccttggtgtctcaagtcctttaggaatgggtacgattgccatgtcataaaccgacttttgaggcttttcgggagggtctagagtcatttgcatgttgtaggtgtttaaacggaacgcagatgcttgcgggacttatcaagcttattcgcacaaaaaacagctgtgggaatggagaaaccacagtcagcgacattggatcgagcggtcccatcatgagaacgatcgatgcagtgt

SEQ ID NO: 6453 - DNA, 291 bp, Bacillus thuringiensis
gttctttgaagacaactgcttcctgctacggttttttttagcgcgggagctataaccagcggacaggcacattgcacccaataatggtgcgatacagatacaaactgtacgtcctggtccatcaataagcgctaatcgacgatagctacttgacccgctgcggctcatcccaatgcggttgctgcgattgactatattgctacaagatgcattccaggaaaagactttcttaagcaatacatgaggcatacactgtattccatgcaatgacaagccatttgactatcgaaa

SEQ ID NO: 6454 - DNA, 212 bp, Bacillus thuringiensis
ccccccgggcctaaaaaggctggccccaaaaaaaaaatcgggaaggggtaataaccatactgccaaagaaataccggggggatatattaaaaccaacgtggcggggcccccacgggggaatactagggaaaaaaaggcccccaacccccctttttgtcactcatttataaagcccatccaaaaatccccgaacttcggacccgagcggtaag

SEQ ID NO: 6455 - DNA, 432 bp, Bacillus thuringiensis
tgcccgggtcggctcaagctgctcgacgactacttctgataacggcctgttttttgtcgcgttgccatacgccccaaccgggggacaatcatcacagattgccacgctcaacacctgcttgattcaacgcgtctggaccatattgatgccagacagtgccacttggaagctctttaggacgctatcctccaccaaccctgccttttaccgcctgcctgtccgactctatacctacgccatgcatcccatttgctcatagctaaggctctggggattcaacatagacttaagttgttcgttaccagctggcctgtgagaacagacgctccgcccagtccagccaccaaccctaataattgatcttaagtgcggagtcctaccctttaagacacttatttcccccactttcccgagacagtcatatccatcgca

SEQ ID NO: 6456 - DNA, 362 bp, Bacillus thuringiensis
caacataagctcttccttatgactctttataaattactagggatcccgtacgggacttatgattttgtgtatgaaaagccagctgaacgattgctcttggcacctacttaagctcaatgtgcccgatcaccaagctttacaatgctcaccagtgtaattcctggagcgtaaaccatcttacttccactggtcccaaatagccggtgcgacttagcaaaatcagccaataaaggggctccattcacatataatgaggcttctaccctggatccggttctacttgtgaacactatgcctttgcacttctctcttactgcgcgtggaatacgcaaactgtttgtttcaatggaggacatattacg

SEQ ID NO: 6457 - DNA, 524 bp, Bacillus thuringiensis
cccgatacatattattcatcgtgacatgcatctactttatgtaatctttaaagatgataaactgggggggtttatagattctgagatcttacaaaacaatgtaaaaatattcgatctatgttattgctgttcaagtcgtttaagcgagctatttagttatgaaagattaagagggaaatggttacatatcgtttgcaaagtctttgaaggttattataaacataatgatttaacgaaagaagaactaaaagctattcggaatgttacgctctcaatgcaaattatctttattgcttatttggtccagctgccacatttattaatgttaaatgaagaaatgctcttctggatttttgctaatagggaagctattgaagaagctatagatcgtatcgtaaaggcatgaaactaataatatttactggttctggcgggtcaggaaaatctacattagcaaggcagccaggaaattaaatcaaatattaaggtgcatcatcttgctgcactatctaggaaaccgattt

SEQ ID NO: 6458 - DNA, 229 bp, Bacillus thuringiensis
aacacagtacaacttttttacggcaagcccgttgccattgcaggggggggctctaaacacgaaaggggaacgcacaagatcagaggactaccactccttggctatgaaaccccgtacactatatgtaaaaatgcacagtacttttagcaaggaacgggagcccagcaaacaggcctcaaaacgagacgcgtccgccctccacatatgatagggcctaaccaacaaggta

SEQ ID NO: 6459 - DNA, 314 bp, Bacillus thuringiensis
acgcgttcgttgggatcccacctcgtgatatcccccgacgtaacacgagtctttccaaacatgtcgtgtgcatcgccttacggctgctccttaagggggtgattaggaggatctcgcggaatattcgacaatttcgagatgcgatccacctgcaccgtggccgtcgatggactatgttccggagcaagccctgaacctgaacatgccactaaaactatcgtgccttttggtactggaacagatgagattcttttccttccagaccgcattactttgctttacccgatctgataaatccggatttgatggtgcac

SEQ ID NO: 6460 - DNA, 358 bp, Bacillus thuringiensis
gatgaatggtgttttctactcaatctgttaagttctgtgtggggaacattgatgcgccgaacacattaaaccggatgcggatggaaccaagttattgaatattcacataagggaagccgttctaccgagattatcgcgctggcagctgaatagaagcgttcgctatctatccaccaatttagattgataccagcacagtttgctaccgaattcatgtatgattcggcatgagcggatccacgtatgaattgccttagaattgataatttcacaagtgttgatggagaggcactgggtaaatcagttgaggaagaacaaccatacttaacgttaattaataaagatgctggatacttaa

SEQ ID NO: 6461 - DNA, 242 bp, Bacillus thuringiensis
tgacgagagctttttctttgcagctgctgtaacctacatgaggggcggcgggtggcacatattttgtaaaccaatggccggctgtgcaaagcctacaggacactgcatgtgcgtgggaaggaaagttacagacattgacagggatcaaatgtgttacctccggaggggtagccacctttccttctctttgccaaaaccgccgttacggcttcccagagacatttcaaacgggatctatcatc

SEQ ID NO: 6462 - DNA, 380 bp, Bacillus thuringiensis
ggctggtgaagctggtcgtcgactacagctgataaacagaatttttcttttgaaatgagagaatccatgagcgatggggcgatcgaaacctacctttctcttattggagatcctgtgccacctttacatcattatatagaaaactcccctgggggacaaacgaccttcttctacatttggaggaactacggcgaacgccgaagcagaggcattaacaagttattaaatgagtttgagaagagccaggaccgataccatatcagggggttattacagccctgaaggaaactccatcaagtccctacgggagttcaaaaaagaagggtttttcacaagtgcaattcatgcatttggtgggccattctttaaacgagaggacg

SEQ ID NO: 6463 - DNA, 426 bp, Bacillus thuringiensis
cgcccacaaatgttaaggcacctaagtcaacatggtttttttcatccttcagcagtggcggtccatcatggtcatagttaagatgatctataatgctcagaacatcaagatacacactttgtacaggaaaacataattaaactcggaacaaatgattttgagagtgaaggcaacctgggcctggatggtgacatgcagcagccacatgtatcgctttcacctagcccaaccaggactactccacggccaatataaacgcttgacacaagatggactgggcgtcgaaacgttttacgacttgaggataaacttccgcaggcgccatgaattgtcctgcttgcacgaaccttatttataaacaaatcatgagagaagatgccttcttaattctaccgcaatccaaactcttaatgcaagttaggtact

SEQ ID NO: 6464 - DNA, 421 bp, Bacillus thuringiensis
tgcgttgagtatgttgcttgcagcctctgaaacttatatgatatatcaagggtggcacatgtattatgaaacactggccagctgtgcaatgcctccagcacactctatgtgcgcggtgagggaagttgcagacattgactgggaacacatgtgttttattcggcttggtagcatccatttcatctctttgacaaaaccgcctttaatgtatctcagagacattcctaacgggattgatcatcatgcgaacggagactttacaactcaagttgctgctgcatcagaccatttagtttggagcaatcacgcgtaaataaaatgttgcgagcgacacgttaataacagcggaggacagaggagactatcgcgaacgcagtaaagatcagctcgtagtgaacctgactcatgaataaagaactcc

SEQ ID NO: 6465 - DNA, 386 bp, Bacillus thuringiensis
atagagcggatcccctctctatacatatattcgtatgagcgatcgagaactctaccgatgaactgcttgccactgtgacagtaactggtacctatgatgcataaggagaacccttactcctttcacttatatgtgagctcgtttatatacctgataattattttggattcgaccctttacacgatattatctatacttttaacactcctatatgcagaaggatattcgccttacagccatctttcgtggctgcagctacaccgagccttcttacgagtgacatctttggtacatttgcccactatatcgatgttactgaaaccgtgggacctcacattgggcatacaatgtgattaagggtcgactgctttaccatgcatactaat

SEQ ID NO: 6466 - DNA, 303 bp, Bacillus thuringiensis
aaaaggggggggctttaaaacaattgtgcaccaaaaagcccgaatcggcaaaatccgatcacaaagcaaaaggatatgcccggaaagggacggatggtggcccggcttggccaggactcatacaagaacggcgctcaatggaaacgctactcgccacatcatggcgacgagcgacaagagaaccatccctcgatgatgtccttgggggactaggggccagaaaccattaactggccaccctaaggggcgcccacgattcgaagcttgactactaacgcagacagtctcttctcaaatggaggg

SEQ ID NO: 6467 - DNA, 230 bp, Bacillus thuringiensis
gaagtgcgtgatcgcaccccggcaattattgcattcttaaaaccattatgtttctcactccgaagtcgactaatttatgcgtgtacttcaagaaagaatgggctgtatttaacaactctcttaaataaaaataaccggcgtcctacttactttgacctgttatcaacttactccattcaacagacagctctccatgtctatagtgtgctctgacatttaattcctcagct

SEQ ID NO: 6468 - DNA, 395 bp, Bacillus thuringiensis
ccaagggcgtgatcgttcctgtctggtccacgggactgagccgctaaatgtgcttaaatcacaacaagcgcacgtacacggggggtcttttacaaaaagtatgcttaatgctcatacacatggggagcaaatggagaacacgcttaacatcaacctagtgcccctatagtttgtccttaaaactgaagcacttattctcagcgcacgaaccgaaccgatagtccgacacacctatagcgaattaacgggccttctaacgcaatatacacactctcaaaaagagctactttacgagcatactatgaagacacacgcgatatcagctgtataaaatgcagcatattgtgacacaccataactggtacgtacgacatttacaaaccaagagatgtaca

SEQ ID NO: 6469 - DNA, 202 bp, Bacillus thuringiensis
actgattgcgtaggttatacatgacgcacgccgaacatgactaatatcaaattctcgacttcgggcttcttgttgatggcctgacataaacgaacacctgactataacatttacggtacacatacatatggatatatgtagaagacaggcatacttaggttcctgtcattactcactgaaaaggcaaggtttcatcacgtat

SEQ ID NO: 6470 - DNA, 210 bp, Bacillus thuringiensis
catattgacagtctcataatggaacaagatgccactacgctacaacggggtcaataacgaatacaggtgaaaaaccgtgtatcagggcgaaagtctgctacgggaacatatacttataaatgttataacgaggtgggggagatgatacgcatgtaatttgtaccgttaggggcatgaggaacttcaagcttgtcagtgaatgccggataa

SEQ ID NO: 6471 - DNA, 261 bp, Bacillus thuringiensis
gggggctattgcaggcgctgtggcgtttgagaaacccaatcgaggctccttcataggatgacgcgctgcagctctcgccgcgctcacccctggaagtatggctgcctgctattcagcaagcggctgaggcgcccccgcaaggctgcgcaacggtgatcgcttggcccaacgcatgttttcaacaatggacctgggggcgaacacctgctgctgcagcctcagctagcgcctcaccacgcgttgcgggccctcacactggca

SEQ ID NO: 6472 - DNA, 300 bp, Bacillus thuringiensis
ggggataatttcttgtcttaacccaaatttttaaaggtgctgtacttccccctccagacagctgtattaatgggggagttttcaaaacaaattgccctttccaacaaacgtaaaacctgattggacacaggaaactgaatgcgtaaatctccctgtaacaatcttaataaatatttgctagcttagctgaattttcaaccaaatggaattaataaaaggatcgtcttatctatgaaaagagtagaaccagatagggtcgagcgttggttcaatcaagtacttgcgttcactattaatgaa

SEQ ID NO: 6473 - DNA, 378 bp, Bacillus thuringiensis
gtggctcacttaacactgctacctcttataaatttacttttttgagagcgtaataaggacatataaccggggactcttagaccattcagagatttcttattcccatctcagctactggggaacgaagttacaatacattcttgatctaggatttcacagagaagattggatagcctaaatatacaagtgcagggttcatggatcaattcttactagattatggatacttatccgatacattgaatccagtatacactgttctctgaaaatatagtatatgctatggcacagagagtgttctaacataaggaggcttttcatggggattaaagggccttgcgcgcctacgagggaagtcatactgagctcaagttcgat

SEQ ID NO: 6474 - DNA, 178 bp, Bacillus thuringiensis
ccgaaagccgatgaacaaccggggggggttttacaaaatcagggggttccacaaaaacacaggatattgtagagggtcggactggctggagagggtctcaataataccgccatatttacccgtatatactcgagacctggctagcttctgacatcttgcaattagtcaggagtgagat

SEQ ID NO: 6475 - DNA, 464 bp, Bacillus thuringiensis
atataatatgctcgctttgcatgtttatgcaataagagggaatctttaaccacttgggttctagaagtcactaatgatttgaagtttgaaagaatttgatccctcatggagggacgacatttttacaccaattggaattcgagtccccacaatttttacctttatcgtattctttttttggcttcttagtttttgttgtttttccattaatactaaaataatttaaagaacaaaaaaaacagaattggatactatctccattttaatcttgtttcctcatgtgctcacactgatttgtgtaaatgttgttgttagtagtaaactctcaataaaggagaacctattcgcactaagatatataagttcaatatttttatttttaattatgttagagaatatttgtactgcattttctattggtagcttgatataaataaaacttttagtacaacatcttttaaaat

SEQ ID NO: 6476 - DNA, 433 bp, Bacillus thuringiensis
cgggtgatgtggctctctgtccgctgcaaccccttattcatttacttgttttagagccctaccaggaccaagtgccggggcatcttgaacaattgggaagtgcacgtaataccataacacctattggggaatgaaaacacgaggtacgcagttcaaggctacggacaaagcagagtggacgggctagttgtagatcgtcaggcatcaaggatcagctgttacttacattgcggatacttatacatagaatgatatgaagaagacaggaatacttggattcactgttgttgctaagttacatagaggggtctttcacagggagggtattcatggggataaaggggctgcacgggcctacgagatatgccatactgagctcaaatgatacgacggctggaaatgcgtttggcacggtaactggaactggtgaacg

SEQ ID NO: 6477 - DNA, 332 bp, Bacillus thuringiensis
acgggatgtttttgttacaaccacccccttcttcactcagtatgtttttcccaaagacacatcggttaaccaccgggggaaattttaatacctggagcttactatacaaaacgaaatcattcacccccttaaaaactcccttcataccagcatcacaccttgtcactaattgaaacaagtcccaatactcttttcaaagcatccaacgcataaaacaaaacgtcttccgcattattccaaaactcaaatgactctaactcgcctatacaccccaattgttcacatcaccaactgttaaaagaaacaatcgctcaggatggcaaattcctaac

SEQ ID NO: 6478 - DNA, 485 bp, Bacillus thuringiensis
aagccactgctgctatagcatcttctgcccctgtagttttgtagtagccattaattcttgttatgtactcgtatgggctcaaggtcagctacaaaaacaaatatattacattagttcgatcaaagtatacaataaataaatcattataaacaaaaatatagtagaccaaaattttcctagccctaattcatttttatatgctattattagacctagcaggacccatcattttttcttttcatttagtaattaagtgtcagttaatcaaactaaggcaacccgtcaagagtcaagaccacaagaccgagaccgaccaaactaaacccattgcaacatccataaattgaaagatgtagtatatatggagaaggtcgtgaagagtactagctaacgccgtcagattattttttttgctactcatgtaaatatctttaatgtgaaaagctagggtttacaacattggtaaacccttacgccgtcagatt

SEQ ID NO: 6479 - DNA, 228 bp, Bacillus thuringiensis
gatttacctttatgtccccaccggcatcttttcacctcgccaccgaatagaatgggccagttttgttttggtcatccatctattctcctacgccagacggggggcggcatatatcgctcgcgcacaaacatacccagatgtccccatgcgcttcaatctccacccgtatacgtacgcctgtcgagctgcgatggaaagcatagatcctcctatgctgtccctagctgg

SEQ ID NO: 6480 - DNA, 219 bp, Bacillus thuringiensis
agtatgggcatagctaacaacacctgggtgtctactattagatgccactgactatatctgttctcagtctactacataaatgacatttgacataaagaaaatgtatccttggatatatgagcggacgtatcttgacatacagagatacccttccaattcttcctgggagaacaccatgtattcgctggacaatggatcaacctattgcctgtgcagcat

SEQ ID NO: 6481 - DNA, 329 bp, Bacillus thuringiensis
taaacggcttatgcctctgatcttttgcttactataaagatgaggcgacattcacgggatggacagtatgcctttgataaccgactcaaatttaatgtgttctgacagaagatctatatggatttggtggaagggcagggacttcaaagatcgtccaagaaggaagctcaacattaggagtaacgtccggactgcacatatatagaaaggctacagtgggttcaatgctggcctgataagaggaatgcatctaatggatattctactgagcaagatcgttaatacgcaactgaagtgggtcgtgtgactcaacagggatctatggcagc

SEQ ID NO: 6482 - DNA, 124 bp, Bacillus thuringiensis
tctattacagtttgatcttgctaacggtacggttgtttttttccgacgaactactagctagatatagggcgggggtttaattatagactttatgctttattaggaatcagtgggattatggata

SEQ ID NO: 6483 - DNA, 197 bp, Bacillus thuringiensis
tatcactacagtaataaaaaacttcgctgactcacctaactgagggggtaaatttacgaaaatggctatacaccgcctgatcatcaccagtaaattcatatcccccaaattcattgatatgagattgttctacgcgctaagaacgatccttggatatctacatgaaatacaccggcactatcaaatcaccgtatgcg

SEQ ID NO: 6484 - DNA, 175 bp, Bacillus thuringiensis
tgaagcgcagttatataatggaataaatggcggaggacccgcggggcctattcaaagcgttgacgcgcgcgaatgagaagtaaattttaatcggaccagacaaggatgccaccaaaggaaacggcaaaaatgggtagatgcacgggaacatagcgaaaggatattaccagaccac

SEQ ID NO: 6485 - DNA, 313 bp, Bacillus thuringiensis
gggcgtgatacgaatacccgcatactctgaaacggacttctttttttcttgcagatacagatcataccaacgatgggggctccttacatactacgggtgcctctataaaaacaaatgcaggtggggcacactgtatattctcggcacgaataggccgaaaaacattctcatgatgcgctctttttttatcatacaccgcatacgcatgctcgcttgactaatactacccatcacatccacatataaaccgaatgggacgtgggtgcatcatctctatcttatgagcggcttcttccaacatttgtggcacaag

SEQ ID NO: 6486 - DNA, 321 bp, Bacillus thuringiensis
cagaggtggtgattgcctgagcagctccaccaggagaagtaatgttttttcacagaatatacgggaggatgcacttggtttacataaagcagcgccactcactctatggagaataagtgatcgcgcaaaatatccatgtaaaacaattcttgtttgagtttctttcatagcttccacatcgtgaaaaataacaacaggggctctttctgtgtaagccccgacatgacgcataaataaaaggtgggcaacagagactaaaccaaccgtattaaactaaaaaaaaggaatgggaatcatatggactgacgcacgtatatgtag

SEQ ID NO: 6487 - DNA, 374 bp, Bacillus thuringiensis
ggaggcatgcaagggatagggcggtttgctgagtgttcaaagaaggaaggcacacggtgaaaagagttatggcatagcacacaacgagatgcagcatgaattggactctgccaaaaggatgacgctatatttagcacataacgatcccagctgaacaagtgcctttttaggtcaagcacgcacgaatggggccatagggcttcaaagaagcctgagtttgttgcctcgcctaaaatggatttcgtactgcttgagggctatcccagacggatcacgccgaatctgaattggacccacggcaaacagccggttgatagttgggaaaccgtttaaataacctagctcaccggggagtcgaacgggtacaaattccc

SEQ ID NO: 6488 - DNA, 215 bp, Bacillus thuringiensis
acaaagggctttttacggtacaaggcccactgggaatgggggggtaaattaaatcgaaacggcttaccaaaaacacaaacctagagacgaaaaccaaagggggcgaaacccaacagcactgtaaccaaacaaatcaaatcccgatgaaagcgccctacagcgctctgaagaaaagagcctggcaactaccgacgaccggaacggcaatctcggca

SEQ ID NO: 6489 - DNA, 128 bp, Bacillus thuringiensis
cgggtgtagacccagcgaatgcaaccttaagagcattttttctgtctggtgatcgccgactcattttgtttaaacgtatatttaagacagcccgttttgcatatgcttaatcgggcgtgcacatggca

SEQ ID NO: 6490 - DNA, 144 bp, Bacillus thuringiensis
ctggtgtggacaccctgacagagtatttaaacgcattctctttgtaaggagataggcaaacagagtggagtacgcatatccctgcaaaacgctcgatatgctaagaaagaccgggcgtgaagtggcccctaccgagggacgtgt

SEQ ID NO: 6491 - DNA, 401 bp, Bacillus thuringiensis
cccatacctgatttttttaagaaccctgaaagatgaccaggttggttggtttaaaaagcaagcgtggtgacatatgaagcttacgaatactaataaatcgaggacttaaccatataaaatgtagcatagcgatatctagtttcgagggaatatcgccttcacatattgagcgatgatgggatagaggtgacacccagtaccataccgaacactggatttaaggtctatagagcgcgtgatagctgggaccttgtccctgtgagagtaggactgattacaaacaaaaacctaagttgcttagacttaaggctttttagtgcgattctaatttacccgaagctttaaattctcaatttaatagagctgatgactaaaaagaatgaaacatagactggttaaaa

SEQ ID NO: 6492 - DNA, 107 bp, Bacillus thuringiensis
tgaacattagacagactttttatagggcggcattgtgtttgtagatggtggtattatccgtaacaccgggaactaatacgaacaacacccaagtcgtgatattctta

SEQ ID NO: 6493 - DNA, 307 bp, Bacillus thuringiensis
acatcggttgttttattttccaatgctaactgcggtatcaggggttatttcaatggaaacggcgtctcaaaaacaccagcctagagacggaacccgtagggggggaaaagaatcagaatgatttcataactttattaaacccgatgaaaatcacactaagcgaaatttatacaggaggctgtgaactcccgccgaacgattagatgatcacgggatttctacttaaagcacgcatatgcactagcgtggtatgacctgtaccaattaccgggcgaagcggcattgcatcgtcccaattgaaggcaat

SEQ ID NO: 6494 - DNA, 255 bp, Bacillus thuringiensis
ataaagcagtgtattttgcgcaaatactcgtagaagctgactggctgggtttgataactagactgaagaatgttgccctctttaatatagctacgctcatgaaaaatacaattcgcgtccgaagtgtacgacttagacaaccacagttaatgctattgatagcaatgtgccgagtagtagtaatactgcttgaatgaaacttatttgttcatctccgggtatacatgcggtgtttccttggacgctggacgagac

SEQ ID NO: 6495 - DNA, 343 bp, Bacillus thuringiensis
gatcgcgagaattgtagggacagttaaacgagcgtatgaaacttctttttatgcatcttgctggaccatctatattaaagatccatgtggtggcgacacattcgaacatccactggtaagaatggctactacgcctataggacgtaaaggtcgatctggcgctactagcacaagcttggatagaaggtgaagcggtatcttagcgatgccatgaaaagagagaagagctatatgcgcggattataatgggcggcttctccttacacgataggcacctgttaaagatccacctgcagaggcagaaaggtttgattcaataaaaggagatggtaatgccgcacaa

SEQ ID NO: 6496 - DNA, 483 bp, Bacillus thuringiensis
cagtacgcgagaactgttgtaacttctatacgacagttaaacgctccattttttgatgctgtgaatggcggcacgatagcaggtgcatttagtggtgataagcccgagctcctaccgtagctaccgattttgtacctacagcccgtgctgtacaagctgtggctacgcgtgctgcgagctggtgtacagagtaactaggatggccttcgcgactaataccatggctatgtgcagctctagctgaagctgctcgacgtggccgaagacaccattgaaaggacactggcgggtaaattgacgcatcgtagtcccgtacttacttgggtaattgcagaccgtgcagttactaatagctttgtggcggacggagcctccgttgtacttcgatgcctacttgttgatctactccacgtaggggctcgactcactcatgtacacgtcgttcctgtacaagcacatgtggggccacacgcaatatagcac

SEQ ID NO: 6497 - DNA, 268 bp, Bacillus thuringiensis
acaagggtttttttcttattaaacaaaaactgctctaggaggcgttgcaaccatcatgatgacatattgaatacagaattattgagagtgatacggatgctggagagttcacatacgcggagtaccctatggccaatcatacataagaactgcaactctgcgagtataataaggcccacttttctaagctggcgccagatgatacaacggatcggcgtgtatacgaagtacacccgcttaccaagtatgattgggattggtatgacag

SEQ ID NO: 6498 - DNA, 271 bp, Bacillus thuringiensis
aaatcacttatttgattttattctgctatctacagcatcaggccttatctaaataaagacggggtctccaaaaggccagcctaaggcctggtaccgtaagcagggcgcggagctagcattattccataaccttctccaacctgactagcatcatataaagcgtcgctcaatatcagaggttgcgaacccccaccggactattaagagaccacgcgttttcatacttgaaagtagcccattctctctcctaagacgaccctagcacttaccg

SEQ ID NO: 6499 - DNA, 272 bp, Bacillus thuringiensis
ccccccccggggtgcccaaaacctccccgggcctcgaaagcctggcccccaattcaaaataaaccgttttttttttttcccaagcttaacccgattaggggggtttttttaaagaaaaacggggtccaaaaaagctcggcttagggccgaacccggaggggggggagggtataaggaatttttccttaccttttcaccccgggggggaattcatagaaggcgaattttaaacagtggtttcgccccccccccggaattttttagggcccccg

SEQ ID NO: 6500 - DNA, 287 bp, Bacillus thuringiensis
ctggaatgtaccccacgcttatgatttggtaacacttctatgtgaaggacaataggcagactgtgtatagggctcgtttggttgtggagacctcgtcattatacgagacaccaggctctaatacgtgcaaaacccaagacgttatattcttatcggatgaacaacgtgcagattgtgagatatgttaattgggaatccatgcgaataaacgatgcatatttggcatcgatatgtttcagaagcaaccacactaaacgatgataatccactaaaacatctagctgtat

SEQ ID NO: 6501 - DNA, 288 bp, Bacillus thuringiensis
atgccgcacactctgtgcgtattgcttgctgagtcggtgatcatctaaaacgctactgttaaaacagccgctttttttgagctcgccggataaagccggcgaacggggtgagacagcactggcacaaagcacaaggagcacccacttgactgccatcgagtgtcacagacagactaccattcaccacctcaccgggcgcacttactgcacctgttccagtcactataggtgctacttttctctgatgtgtgcgctggacccctatttccccacccatctatatacatt

SEQ ID NO: 6502 - DNA, 105 bp, Bacillus thuringiensis
cataaaaatacaccatacaacacccacactttttttccaaaaaacacaaaactaaccgagccagggacaattaaaaaacactacccctttccaaacaacacacca

SEQ ID NO: 6503 - DNA, 253 bp, Bacillus thuringiensis
cactgccatgtcgatattagaagcagacttggttctcttttcgaagttccagaatgataggatgggggggttgttttaaaatacctggtaatcactgcaaacacagtgggggcagacaaaagggccgctatcgtaggggcattacaaatagccctgcttgactgagaggacaaaacagagggttgagcaagcatgatttgggaatgtagcaacgctgaggattgggacgcgctattctgcatgaggcggagct

SEQ ID NO: 6504 - DNA, 204 bp, Bacillus thuringiensis
caacttttgctgtaacgactgaggtgcctccggggtgggcatgttgacattaattgagatgtggtacatgtccaccaaccaaaggatctgccgggtttgccggactttgtcaggatactgcctactctcgtactgaggctcctcgcgcaatgtacgctcttgctctatctaattgaccggcatattgatctcgcattgcaataa

SEQ ID NO: 6505 - DNA, 287 bp, Bacillus thuringiensis
cgctctcgtacactttcactgtctgcacggtttctcttaatacataacgtccgatcctggggagggtttacctacacgttccgtaaacacaccgcattgcctagcgctgcttgctagactcagccaaagctatttagcactacaaagattcaaccgtgaaaagttcgagggcagccccagcttgtcaaaagtgtccgctctcgcagccctcggacgcgcccatcaaacgcggtaaaaccgcgaatctggccgacggcgcactcctgtgaaccatcccaccattcaag

SEQ ID NO: 6506 - DNA, 241 bp, Bacillus thuringiensis
ccaccagaatatttttttgttatcgaaggcccggctacatggggggagttaaaagctaggacgggcgatgtgatgggctgtcaggagggacgtgttctttcgagctaagccgacggcaggactctaaagcgaggggggacactgtgttttacgagtgaaagcattcttgaagaaaaagagagagtgcacaagtgggcacatgtgacgcattctggattggatcacacgttcgtgggatcat

SEQ ID NO: 6507 - DNA, 313 bp, Bacillus thuringiensis
cgcctttcatctaaatgacaaagtttcataaacgtgttgtgtaaccgaccatcatgaaaatgagcaatagggctcgcataactggctatatcgcatctactccagctaaacaatcagttaccatagcgtaatcaaccatgtctgcgcttcccttataccctaacaaaggccaataatggcttgcctggtatttcgcgcatctagacccttctataacaacaattggctgaaacagtagctctgtacacgagtgtgtataatgttacaaccctcctaataaaggttacctgctcaccaaataaaggacgtaaga

SEQ ID NO: 6508 - DNA, 249 bp, Bacillus thuringiensis
aaccaccgagcgctaacaagccagccgcaataccaccgaataaccaccagtacataccaccatcgtctggccccctccctcaatcggcccccggctgaacgaaccgaacagttacaacgacaacccgaccacccataaagccaccgcacggatccagctgaagtcccgccgccggaccgaatgccacaagaaaagctggcaaaacaacatcacgataaacgagccgaacataaaagacccaaacaacaa

SEQ ID NO: 6509 - DNA, 271 bp, Bacillus thuringiensis
cgaccacagattaagaaccaccattttgttcccaacacgcgaaagacacgcagagggaggtttgtgcaaaaccagaggcagtacaacaaaaccccgaaaccggaaaacacggtgcaacaaaccccagaaactagggataaggaagaacgaccaataccggcacatacaaaagaaaaagaccctgcaagaaccggtgaccaatccccctcacacgcaaccgggagagacaagcacctgccaaaacacggaaaacaacagatgatgcccccac

SEQ ID NO: 6510 - DNA, 196 bp, Bacillus thuringiensis
ctcgtttcgtatcgaacgcggattgcgtgatgtcgcttgtcaactaactcaaacaaaaggtttttttctgaggagcctaaggagcgagcggggtgtgcttatttgagttgggcttactgcccacttgccaggcaaatagcctgtgaggccttctagcttaatgaatccagcactttggcgctgaggggggatttgc

SEQ ID NO: 6511 - DNA, 142 bp, Bacillus thuringiensis
gcgagcaggcacaagcgtgagtgcctctaaagcagtttttgatatcgcgactggctatcgagcggatttagtcgagttcactcatagactactattgattgatcagccgtagcgacttggaggccaccgtccatggcacaca

SEQ ID NO: 6512 - DNA, 245 bp, Bacillus thuringiensis
cgcattgaacttcattcaaaacatattaagttaacaatcataataacggtaagaggcttgatacggactaggagaaccagaacttcctctcgcatgttagagccagaccacatgtttaatcttataccgccgcaacgataaattgacaaattgagctcatgacgcgtatcgaaatccatgggaataaataggcattttaagacatcctcttgatactaaacgaattggacgctggacgctggata

SEQ ID NO: 6513 - DNA, 102 bp, Bacillus thuringiensis
gcgatgctgctgacatactctttaatagtatgaaagaagttataagatgattcaatgacatttgcgtgtatcacctgtcccttctgttgaggtactgaccct

SEQ ID NO: 6514 - DNA, 273 bp, Bacillus thuringiensis
tcccccaattttgtttgacccatacaatccttccccaatcgggcagactttaaaagaacttggggacatacacgtgaaccggaccgcatatctaaagaggtaaccgctaaccgatcaaaaggcttttcttacaccttctttccatataccccaaaaccgcggccaagacgcatttttccttcaccctacacatccaaacgatggacgctcgacctatttcgcacacccgttcaccctaaaaagccgtagctttatcaaaattagacccccccg

SEQ ID NO: 6515 - DNA, 430 bp, Bacillus thuringiensis
aatttggtaaatgcatgcattccttggttatgactagtgaagtgagacttttgatagtggtttatcccgatcttgtctgagtggccactatttgcgaatctttgaagctccatcgcaccaaagttatgcttgttgttcacctgtctgtgaggctaagcgatctgttcgttactccgtgggtcttgtcttcctatcagatttcgaatctgtgttcttctgaagtggattctgcatgcatatatatatgtatatatgtctagcctctcgttattggtttatttaaaatgtatctgcagatggtgggaacacgatccaatggatatactgcaaagtgtgaaagtgtgccttgcgaaggctctcgacgaagacactgtcgcatgacacaacgtcgaccgtggcttgaacgccagtgggcttacatatcagagag

SEQ ID NO: 6516 - DNA, 151 bp, Bacillus thuringiensis
agacgcgttctgaggggaaccagcatgggcgatggtttactacggtgcatcgacgtatacacatcaagtggtgtcgcccctaccaacacagaaccctcccggggatacttagaacatatagtcagacaaatacaccaggaggggagcacaa

SEQ ID NO: 6517 - DNA, 567 bp, Bacillus thuringiensis
ccggggctggagaggttggccccctttttcatttccggggaaattaataatggcgcattaagggccggcccgcagggggggttttataccaaaaaaacgggccgcgtccccaaaaaaggtggcccttaaatgggaacccttggtggctcaggggccccgacaccccctgggggaaagggccctggcctaaccggcccggggggggaaaatggtgggatgggcgggtttggaggaaccggcccaaggggattaaatggaggcgttccgggtttcccaaagggggggggcgggttctttggccttaaggggaaaggactacccaaggggcccggtaggaaaaatcccagaggggggaggggcccatttccaagaagagggtaaaaaccggggccgggttttggttttttgggtaggagaaattggggttttcaaaccgcccttaaaaacccggtttaaaaggagggggtttgaaatttttgccaacttcccgaaaagggcaggggctcttatggaccagtgggaggcccccccccaggggggcaaccgttggcccgcccttaatggggg

SEQ ID NO: 6518 - DNA, 326 bp, Bacillus thuringiensis
catttttggaccaattgatgaagccagcccaggggcgcgtggaacgggggggctttttaacaaaacaggtactgtacaaaactacaataaaagtaatgaacagactccatgagcgcataccaaggctgatacatccacagcttcatttcccctcgtcatgaactttattaccaacttaagcatgggcgtcccacatgggactggaacaggcatcgtgctaagcggaatgacagcagcgggagttatcgcggatttcattaattaaccctcgtcaattacccaagaccgctaagacaattagcgactttaacgaatacaattcaagc

SEQ ID NO: 6519 - DNA, 263 bp, Bacillus thuringiensis
gggcttttttgaaaaaaactgggttccgcacccagactccccccaacagaactgatcgtcaagttcacccaaaagcaccaagccctacttaccttcatccaaggcttatgagacccatcaaatggcacccaccacactggggaacagtctacactccacgggacaggggcgaaacaccccgcgaattgcccaaatacccccataaaactggcctttgctgcaagatcagtaagacattgccaagcaaagggcttactcccttc

SEQ ID NO: 6520 - DNA, 180 bp, Bacillus thuringiensis
aaaaaaacttttataacctatatcaatatccccacatactgggacatctttaaaactttgtttatctcaaatcatacctcaatatacaacattacacaattatctacccattccttattttaacatttacttcattttaaacgacaaatataaaagttttctttttaaacacaaaaaaag

SEQ ID NO: 6521 - DNA, 131 bp, Bacillus thuringiensis
cataacgccagttacttaacaaaacccaccacccccccccagggggatttcaaaaaaccccccgccccccaaaacaccacccgacccacaacccacacccaaccaaacccccccaacaccacccacacacc

SEQ ID NO: 6522 - DNA, 243 bp, Bacillus thuringiensis
gaggacgattatgtaaaaacgctcccatctattcagaaagagagcattttaaaacccgcgggcattaaaaacaaccaaaggaacacggacaggaagacgcgaaaagcaactggcgtatacaagctccgaatactataactaccaaacagacccatcccacgaacaacggaaacacacgagccatcgagacgaactctcgcaggaaaccacatcaaaaggacttcgacttacaaatacaaacaa

SEQ ID NO: 6523 - DNA, 436 bp, Bacillus thuringiensis
gtagcaaccagtgtccttagaacttactgatcatgatttttaacaaggaacgatcttaaacaatctgatacgaatgctcggcattaggcggaaaaggtacacatactgtgtaaatactgtaaccaccaaacatatgatcgaatttgctgggatcggcgatgaaatgagcattgcaccacgaggaataaaggaaattgtcagctacgtaacgtgatacagaaatgaacgatggcgatgtaactgtgtagagagaatagccatagaacggacgcacttgtgaaagacttgcattagacagaacctgtatgatgataaatgctatataataggttattattaaaaatgtaatgcgttagtgactatattatgaactttggactaagcatcgactgtaaactgacgatacgtatatagatgtatcagatgaaactattgt

SEQ ID NO: 6524 - DNA, 357 bp, Bacillus thuringiensis
tcgttagcgcaaatattatcgttataaatcgccgcattctccttggcaatcagttcactctctatccgggggggcatttgattgcgtcaaagattctatcagaagaattccaccgaagtatgaacaaactcagctaatcctggaaccagaatacactcattagcctcttcataccacaaccgtatagggccataagccgtgaatacgcactaaagttggaatttcataaccatcgaaactacgcaagatttcttgggctttatggagcgccatatacgataaatgccgccctaaagggagcccacaaaatagtgcttgtttgcatacgaacatagtccggtctttcccctcacctaa

SEQ ID NO: 6525 - DNA, 331 bp, Bacillus thuringiensis
atttgcttgctattcatggcgcttaacaggacgttgttttttgagcactacatggttcctattgattactggcgcacctatgtgcgggatgagtagctccactacctgtaggcccgtttagaggggcattactcttggctacttataaattatctaactagatgtagaagtaatgcggctgtagtgcgtatatacacgccaccgctagcacttttttcgcgctattgtgaccgatgacatacatttgtcaatagtgcacgatgatataccggtttaggaacatgtttgaattctacttctgaatcacttgcacagatcctcttgtacaatt

SEQ ID NO: 6526 - DNA, 590 bp, Bacillus thuringiensis
tcgagtggcgaacgaggagggtttgtgtgtaacatttttagagaaagcgatctgccagatacagaaagtgtgcatgtctatgcctaatatacattcaccgctggagcgcgtgactatcttaaacacctatggacgatgcaaggataacgggattagcatatgggtatgcttgtccatggcgatccatgatgcagacacgcctattcgcattaatagacaggacttctgttatgacatttatctgcaggtgcgagatagcatagccagattgctgtgatctgcgtaccagcatcatcgatgcgaccagaagtgaggatgatagattggtcgaattcgcccttaaagtaagaggctgtcgagagctgttccatgcacttaccaagcgatacgcttgcacaactctgagagaagagcacaatgagtaaggacgctttgatgaatatgaagagtcagcccatctcaaataacgagctaacgtactgtcatgacaccatcttcatacagaatagccgcttgctcttacaacagaaaaccggtgagttatgcccccactctcagagagggcaatttctctatacgctctaaaacgc

SEQ ID NO: 6527 - DNA, 251 bp, Bacillus thuringiensis
acccgtgccttttatgtacacgaaacaacgtccaaaatgatgagctagtgccggtaaactatctttacgaacttgttgtatatagagtcgatataggtctattcatggcaattagctgcaaaagcagatagtccttggaaacactgaagcggatattatccaacgatgagcctgccccattacactgggtttgccgttgagataacacataatttgatgttacattaccatgatgcaacatattgatccaa

SEQ ID NO: 6528 - DNA, 216 bp, Bacillus thuringiensis
tatgggctccgctcttctaaatcgatgctgaaacaccatgctaggggggatttatactacctcctgggttaggaccgccttgcgcctaaagtatacttacattcggaccaatcttcactctctctagaacagccctatgtaattgcgcgcgcgcttccggatggcaccccaagcgttactagtttgtgagcccccaacagcacctgatccttaaca

SEQ ID NO: 6529 - DNA, 159 bp, Bacillus thuringiensis
tatctaccagcttcagtcgttcacatcaaccctacaacaattacgggggtattataaaaaatctgcgcctttattgccctacgacatgccccattaattcacagttatccttaatattctcaactcaatcaccttcaccttcttatcattaccacttaa

SEQ ID NO: 6530 - DNA, 162 bp, Bacillus thuringiensis
cttcctagattttatcttgataacaactacacaacaattacagcgaggttttcaaaaaccagtgcttttataaccgcaagacgtgctctattcgttcacgctatcattaatataaatcgcacaattatcttcacaatattttcagtcccactctcaaactta

SEQ ID NO: 6531 - DNA, 220 bp, Bacillus thuringiensis
cggctccgtttttgttgaatagacccccctacaccatgtggagaaaatgggcaatatcctagcggtcagacacctcactttgaccacgtcatgcactggttctattccaccttgtccatacattaagagcaattatctacacaggaggagcattctatgcttttaaaacgcggggccaaggtctccggtcctatctaggttccaccagccaaaaaaacat

SEQ ID NO: 6532 - DNA, 389 bp, Bacillus thuringiensis
catggaagctgaacaggggtgatctttctaattggcaatatgttacgagcgactaattctcataggaaagaaagttgttcgaggctccggagccaatgaatacggccaccttacctcccaaaatcgggccatagaccattccagggtggatcacacacacgtagaggaatcgtcggttaccatccacttgctatgaatcattaagaagacccatacatgaataatctcgagggtgcgttctacattaactttagagcttgctagttcacaacctactaggaaattgagattaagagaatcagaagcaaagcaaaacacatacattgaatgctgtgtcgtatattccacaaatattctgttttcacgctgagcctttgctccctttctac

SEQ ID NO: 6533 - DNA, 198 bp, Bacillus thuringiensis
caagtcggtttttttccaactggaacctttcaccatgggggggtcatttgcaattacctagcggacagttatggaactctcactttgagatgcgctggatgcttcgcagcttgcggagctaattaatgccgtaagtaaatcccgtggaaaaccatagggggaataactgggacagccgctgaactcctatatgggtca

SEQ ID NO: 6534 - DNA, 180 bp, Bacillus thuringiensis
cttctaccaagccttaaacatccgtcacttttttttcattcccaacacgaatttgccacacacggggttgtttaaatcccttgtggtttaaaataacaccaactactatcacaatcgtctcccctacatattagattctcaacttcctggtgatacgtacccactaactcctgcttcaat

SEQ ID NO: 6535 - DNA, 102 bp, Bacillus thuringiensis
cgacaggaagatattcttgcacccgcaataacaccctgagagggagaggattcaactgcataccccaacgaacctcaaaaataatggactaacgattgccta

SEQ ID NO: 6536 - DNA, 423 bp, Bacillus thuringiensis
ctcgactagtggtgttagtcgccaaccacccctatcccttggcgggggacttttgatacccaaccatgctgagggaaccgttgggggcccacgggacacttaatgaggcgaccgtcccagtcaaacagccgacctgacactgtgttccggatcgataagacccgtacgtgataatttacagaacaggaagggcggttgcccaccagtgccaccaccgaagttagcgctcccgttttcaatggctccggcctatcctgtacaaactgttccaaaatccaatataagagctccagagaagatgcacggggtcttaccgacctgaagagcgtaacctgcatcttcacaggaaccttaatgtcaaccatactctggcagagacagagcccacatcgaaacacatttcgggcggaccggaacttaccc

SEQ ID NO: 6537 - DNA, 448 bp, Bacillus thuringiensis
cttcttgctggttatgtacttccgggaactcaaggaatactaggttggtcaggacttactgcttctttaattctgcatgctctaactctcattcaacgtttcgctgaagaacatggtatggacgctccgttgtattctggccgctagtataaggcgagaaatgacgacagttcacctttgatacggagctcactaccttcgtgactaacgctaccagacattataaagcgtggattatatgtaacctgttagctcatcattggtttaaagatcaactgtgcaagtttcgggagtttactactaatatactcgactttaccagatttaataaacccagaccatactgccatcgtatatagcggagcctatccagtaaaccaactatcacgagtggcactttctggaaacttatatcgaactaatagctttgatgacagaatgcgcgccc

SEQ ID NO: 6538 - DNA, 353 bp, Bacillus thuringiensis
ggaacatacgaccacgcatagcccactgtgcgtggccttttttcaaggaaccaagagcacgattaccatgggctctattgaggcctgcatataggaaaaggctactaggcacgggcaatacagagacagggaactacaggtagaagctgcaaatgaccacctaatgaatcgcaatgagacggaagctgagcgttcctgaaacatcaaaaactgcgccgaggactgagagactatgatcgaaatgagaaccacgcccgttaacgttagcgagacgaatgacgtatacggtgtgctgggatcaaccagggatgagggaggggaggttacagtcccagagggaagttgttatcata

SEQ ID NO: 6539 - DNA, 433 bp, Bacillus thuringiensis
tgcggggtgtttttttactgcatgcacggatgggaggccggtaccatcaggtagaggctataatggtgtgtcagcgaggccatccccatcagcatacatgcactgtgcacaccattgcaggctgtgtgtatgtccaagctggaccgcttgaacagcgaacttagctggcaccttcacatatatgagctcaatagaaagtcttattgttgtagccatagactcttccctgcagttttactatgcgcatgaactgcagcatatatcaaacgaggaactgaaatggacttttcatactgtttaaacatggtgtccaagccattgagagactagagacatgccgtgatacggcacattatgcgcatcaaatgaatcagtgcctggacctcgtttaccatcaaacacgttgaattgtccaggtaatgggatgttgagc

SEQ ID NO: 6540 - DNA, 401 bp, Bacillus thuringiensis
tgaaatggtaattgcttttattccagcaaaagcgcaaaatgatggacttataaaaattaccgcaattaacggttatactggatatgtacagaaagagtacgaaaaaactgaaatgaaacatgcatcgatgcccgaaaagaacattgaaggaacatggaatagaataaatgtagattctatatgggaaaagaggaaggtttaacactaagcacatccatgacagtgttaaatctatagacgaagagtaacccacacctattaagcaactgctgtaactagagaacgcaacattcgttgagaaaaaataccagtaacctcatccggaacggtaatttgtggattcacaattggagtaactgcttttgaaagaaacacagagtaaccgttattctgatcattca

SEQ ID NO: 6541 - DNA, 105 bp, Bacillus thuringiensis
cgacaggaagattaatatccacaaacaacaaaaccctgacaggcgggggaatatttaacaaacccgtaagaacctcaaaaaaaatggcgctaactacccccacaa

SEQ ID NO: 6542 - DNA, 375 bp, Bacillus thuringiensis
ctagcgttcgcgttgtcttaaactataaagggcgtattacgggtgctgagcgcgtagacggacagtgcatcaagggtacggatgtgtcatctggcggcattaacccgacggtgaaaccgccacatgtagcgatcccagcgctaaactcatgttcacattggacagccactcatcacgattaagaaattgagcaaagatgagagaactagtggccgaacaggaaagaccatgcgtatattggacggggctgacagacccggcgccactatatagtttgtgagtcgaaatacgggaactgttaaaaaacgcgccagtggacgaacaaaagccattgcaagaactaggtgctgctgatcatactggtattgaatggga

SEQ ID NO: 6543 - DNA, 371 bp, Bacillus thuringiensis
ctcaacggaatccaaggcaaatcatactagctgatgattgtcttcagctgtgaaagatccctgtggatcggattacccaggtggtgatcaaatcaactgaaaagctttttggaagtatgcccccctttactctccctgaagatcctccaagctctgttagaaattgtgattatcatatcattatcttgccttatatttaggacaattgctcaagcatcacaacttggagaccgattttgaaactaaagttcctagcttgaaagagttcgctaggacaaaagccattgctaacacgaaggtctcaccatcgagactactggcgaatgtgatgcagcttcttcaaaggtgtgcctatagtttattcacttaca

SEQ ID NO: 6544 - DNA, 105 bp, Bacillus thuringiensis
cgacaggaagatttttttgcacaaacgcctactcgctgagtgatcgcggattaaataccatacctgtaagtaccgcacaaattatggactaacgctctcctacaa

SEQ ID NO: 6545 - DNA, 404 bp, Bacillus thuringiensis
gatactcacctgaatgcgaaacggataattgcgggatactttctggcaagtgcggtcttagatgctggagggtacatcctgagcgcatgcggccaatgggaactcggactggtgacgtacaaagcagcttgccgagacctactctacttattacgcaacccattatacaacgagcgctgtctgtcgaatgatgacacaaaagcgctttgtcgaggtatatatgattgacatagttgctatgccatgaacgtaaacacgtaattctagcataccatctaataccttaaggctcattcaatgttggacaataccgtacagcattactatctctaatgacaactctcctatattcatcgaatcataatagagctataaaacgcaatcgtctattgcggatacctgac

SEQ ID NO: 6546 - DNA, 250 bp, Bacillus thuringiensis
atttagggaatctttttacagtgcgaatgacagatgagctgccatatgacctacaagaacatgaacattgtgtggatacgctgactacaaaaggacatccaccactatggcgattgtaaagatacatccaggaccttggctcacaaccaatcgagaacctagtattgctcctatgaaggcacctttaaagattgctggaaaacgaggcgccaattaaaccatctccaataccctttttctagaaaacttt

SEQ ID NO: 6547 - DNA, 359 bp, Bacillus thuringiensis
caaggtaaaaggtttgctcatcttggatgcactttgtcggatggaagaaagctaaaatgggggttgccccacgtgttccggaggtcccactaatgggtggtggcgcaacaactttttttacggggaggggttgggccaccaaaaaggcgggggtattaagaccttttaaaaaatttttggcccatttgggaatggaaggggaaacgttttttgcaccaaatagggaaaatgcccgaatggggaaccgatccctaaccgcaaagattacatgggtgaccccgcccttcccttatggggggcccgtttaagactgtggcggaaccaagtgaaaggacgtgttcccgggggaaattggtttc

SEQ ID NO: 6548 - DNA, 303 bp, Bacillus thuringiensis
atacccgttttttatgtgttgaaaccatatattataagggtggtttttggcggccgtgcaggtatatacttaggtgctggagtatttgcaacggctacggaagttggaggggcattggataatcactcccaaggtcaacatgatcgtagtagcacctaaggtgagattactaaggcaaagggcttgtactccgattttgagagagatttgatagtacaacacgcttctgaggaccggcaaagtaaatgggaacactattaataataatggcacttattgcggtgggggaatcggccttgacac

SEQ ID NO: 6549 - DNA, 353 bp, Bacillus thuringiensis
taaggtacaaggttggaaatttttggccagcatacatgtataatacctaaggtcaagatgtcactacagagccttcgggcaagcgctaactcaagagacatgccatacaatggctagtgctctccgggtcgataactaatagtcgttgcaatcagattggctattcatatactcacgtaccatatgggcgggggattaataatgatcacgagtaggagaatcattagaactgtttaccatacatacccatctaactttgttagaacagtgtggtttaagactttcagcatgagtcagcattgattcaccacctacatggtcttccatgagactatgatacaattccttaggag

SEQ ID NO: 6550 - DNA, 159 bp, Bacillus thuringiensis
gatttattattgtaagaccatcacattattctaagagttaggggtcgtccattgatcaaatttattttttattccagagttgtgcacatttgatgagagagacaattgagtacacgtggggaaatgttctgtcctcactggatggctcttccgacaatg

SEQ ID NO: 6551 - DNA, 536 bp, Bacillus thuringiensis
gacaaatcatcagttataggaaaaggagctaagaacggtgttactcccagttctccaccattactgtattcatgtttgggttctttttgtgagcagaaaggaaattgcagtgcggttgataagctatgcggcatccttagttccttcccccacaaacgaccaactggacaagtagttgctgttgttgaaaagtcacttgtaagggattctatcgttggcttgcttgatgtcaagggatggattcattacaaggaaagtgatccaaaaaggtgcaagtctcctctgtctctttcggatgatgaatatgtccagctgatgcctgcagaccctaggtttcctaaattgattgtccccttccatgtcttacctggaagcattagagcaagacttgagaatttggatccaaatctcgaggcagagctggtagctgcccaaattgtagactgaggcgaagggagtccattttctgtagcccaaattacacatctatttggccgaggcagtgaattggagcctcagatcaatgcgatattata

SEQ ID NO: 6552 - DNA, 180 bp, Bacillus thuringiensis
aacacgcctgaaatgaacttaccatatgaaaaggtatgaatcagactatacaatactcatcgcacgtgtctacttgaaatgattgtacgccataaccatcatatgcaggcactaaatcgcctggaggtggtgatatcatgtcaactgatgcgttgacgggtaaaccgaacacatcatgat

SEQ ID NO: 6553 - DNA, 116 bp, Bacillus thuringiensis
tcattggccttagttttatataacacagcacgacatgcttattttgagggggatatttaaatgcagaggtggattctgcaacgcacaattacaatcaacgtcataagctagaaact

SEQ ID NO: 6554 - DNA, 422 bp, Bacillus thuringiensis
tggaaacccacgggggggcccagctccgcgttatttatattacctaaggcgcaggcatgccggggttacaacgtggactggaaaaccctgcgtaccactaatcgctgccaatccctttcgcagctgcgtatgcaaaggcccccgatcgccttcaacagtgcgcgcgatggcaaggaatgtagcgtatatttgtaaattcggtaatttgtaatactattttaaccaatggcgaatcgaaaatcttataatcaagatgaccggataggtgagtgtgtccgttgaacagagtcatttaaagaacgggctcacgtcaaggcaaaacgctatagcgaggccatcggaacatacctaataagtttgggtcgaggcgaagactaatgacctaagagccgattaactgcggaagcgcacgtgagaagagg

SEQ ID NO: 6555 - DNA, 246 bp, Bacillus thuringiensis
actccggtgttgtcaaaaatgtaccagtcgtggatggatggcgtttcttaacagacggtgcatttccctccggtcaaacatgaaaaggtgaaacaactatttgtgggtgtggaaacggaaaatcaggcgcttgtaaataaagtgaagaggacaggtaggggagcactagaattaaagatgattattaacttaataccgtgcattgtgtttaacatattaaaggacttctttgccagttttatcata

SEQ ID NO: 6556 - DNA, 390 bp, Bacillus thuringiensis
cctaaactttttacccaaaaccgttaaacctaaaccttacaccctaaatcccaaaacctattatcttacccctaaaccgtaactcctgaaccctaaatgctaaacccgaaaccgtaaaccctaaaccctaaactcttatccttaaacccttaaacctaaaccctagacacaaaaccttagatcccaaactttaaaacttaaatcctactttaggcttccggaatccagttgcggttctagttcttatgctcaatgatacacaaagcatctagtcatatttgactacaaatcccctaaccaagcttattgttgattctcaaagctttgatagggaagccgatggctatgagttttggtttgaatcgttcacaaggaagcactacttacttt

SEQ ID NO: 6557 - DNA, 483 bp, Bacillus thuringiensis
tatagcgaggatgttcaaaagagaaggggttaacacccgatgcgtcttttcagaaaaaagctgtaactcatcttgaatacaaagcttcataaaagatgccaccctctctagctagcttgatagaaagaataacgtttttggacactggtggggagagcaaattcttaagatcatgcgcatgtaaggaagggatattcttggctaaaatgatcaaaaaagacaaactctccactgtgaggagacggtccaaaaccatgatccctttagtttagcaacctagaatacggtgccgttaagaatctttcccttttgcatagcccacgggttgtgcatcgatactaacaacactggactagaataatgacttaaaactcgctaggacaggaagcatacccatcatcatgacaaatacattgctggacctccctttgcatttagcaagcactgatgcttaatggatcgcatacattggtagtctacata

SEQ ID NO: 6558 - DNA, 259 bp, Bacillus thuringiensis
gcttccttattttatatgcgataaaacataccaaccggaaggaactgtattttacctgttacgtaaagatacatgttattggaacccactatctacaaacggcactttcgtgttactctatggcggtgtttcaaaaaatgaagaaacgaaaacgcatccatattgtggatccttcattctgctttagccaacgggaattttctactacattagaggggctttgccgatcgtcagaccgatatgaatcgatgtcggtatc

SEQ ID NO: 6559 - DNA, 392 bp, Bacillus thuringiensis
aaaaataggaaaaaaaacttttacgaaatctttattcccttaaatcgggaacggaatcttttagagaattatcaaaaaaactccccaaaccacacaaattgcaacttctaaatcaaatacgacaacaacatcaaaccatacagatacaacatacactaataatacaacactagaaagtgctaaaacttcatttaaaaatacaggaaaccttccttggatagatacagcatcttatccacaaacaaataaatcaagaagctacctatgaaaataatacttgcacaaaacgcaataaaacctaaatacggttcttgaacacacccaaacgaatgaaatcactaaaaaactagactttaactatcctaatggtaagataaaagaaccttatctta

SEQ ID NO: 6560 - DNA, 244 bp, Bacillus thuringiensis
aaacaaggacagacccgggtattttgtttaccaccataatggctttatttttgagagaatgcgataattcctaactacaggtatatggcgtgtaaaatcgcaacacccaaatcaccattatgaaggattaaggcaagaaaaatagactagcgtaactacgactagactagctttgcaatcaaaaactggccacgaaacacttgcatcgtttcgtgttgaatttaacattggcaacttttgtttt

SEQ ID NO: 6561 - DNA, 270 bp, Bacillus thuringiensis
gggcagaaatacagcgcgggggttttggtaatacagtagggctaaaatggcaacaaggaacctcatacacaaattaaaaagagtacgacggggatatagaaggaaacccaagtgatgctatggaagggtcaaagctctgcaaatcaaagttccacagtgaagaaacactgggagtgtgccaaaaaaccatttataatatggatggcatcgtacatccagaaagtggctatgaagatgcagacggcttagattatgcaggctccaacgaaa

SEQ ID NO: 6562 - DNA, 212 bp, Bacillus thuringiensis
catttatatttataaaagggtattggtttcctaaaacaagagacagaagatgggttcgttcaatctcatttggacggaactatctcattttgcgctggagctgattgttattttggatttgaagttttttaaaaggatgaacaactctcgtatcgtgtatacacgaaccattaaatattctattaggcacgctcttattgtatcaagagttt

SEQ ID NO: 6563 - DNA, 141 bp, Bacillus thuringiensis
tgaccgcaagagtttttatatcaaaaggatcggccaactcacatccgggggtttatactaatcacgcgagggctaataaatcaagggctctaccgttccctattacaattactaacggcattcatcccattaacattgctt

SEQ ID NO: 6564 - DNA, 391 bp, Bacillus thuringiensis
cgacaggaagatttgtatgcacaaacgcctattccctgacaggtcgcggaataattaccatacccgtaagaaccgcaaaataaatggcctgaccctcccctacaacagcgcccattgtacatacttcacatcgggccgagatgctcgtaaatacgctacgttgaaatcgcctatatcattgtcaaagaagtggacaaaggctataaagttgctatacacgaagtgcgtagaacaggggtctgacttcggtacacactcgaatccgctttacattttaaagactaaagcctgtagaacgatcgcttccctgccggtacgctataagctccttgcgatcatccaacttgcacaaatatgggttgcattatcaaaggtaccaatttaactacct

SEQ ID NO: 6565 - DNA, 216 bp, Bacillus thuringiensis
ctgcaggaatatttataattactacgggcaacaaatcgagaacggggggaattagtcggattcgacacggtactacacgtgcaatggcagacacagtactaacaattggacaaacactccaaaagtgtccaacacccataagtcttatatctgcgtcaacgacaatgacaacacgattgaggacgacagccatccgcagaggagactggtgacgaa

SEQ ID NO: 6566 - DNA, 200 bp, Bacillus thuringiensis
cggcgactgagttctccttgtgcaatgcgaaccacgtcggagtgagggtttaaaaaaacggaatagatatgcgacatcgtctagtgcacgtgctgcgagatctggtgctatctattgtcgtacctaatccagagggggttccagcaatttacctttgcttgtgctaatggttccagtagtcgtataagcactttctttgg

SEQ ID NO: 6567 - DNA, 117 bp, Bacillus thuringiensis
cgcgcggaagaggtttcatatcacgcagttacttacggacaagttgctggaggaattgcgtacgtgaatgacgctcaaaaatcatggcctaaagctgacctacaagatcgagcaaaa

SEQ ID NO: 6568 - DNA, 305 bp, Bacillus thuringiensis
cgacaggaagagttatatgcacaaacgccaactccctgactgatcgcgtatgaaataccatacctgtaagaaccgcaaaaataatggactaacgctcccctacaagagcggccaaaatacatcttccaatgagctgagtagcttcgaaatacgctagttgaaattgccgatatgattatcaaagaagtcctcaaaggctataaagaggcgaaaacagtaatgcgtagaacatgggccgtactactgcacacacttgtacccgcgttacatattaaaggccacagcatgatggacgatcgcttacc

SEQ ID NO: 6569 - DNA, 201 bp, Bacillus thuringiensis
ggtctgaacgaaaatttttttgacagcacagaaggctagtaaattgggcgcggcattttatgctaacgtggctggtgaaccgcttcgaacaattacgggcggcgtgccgtaaataaaaggagacacccagttagattgacgcgcgtactgcccggaacaattggatcatcttcgcgaagctcttatgatttaaccgtgagg

SEQ ID NO: 6570 - DNA, 165 bp, Bacillus thuringiensis
cgtgcgcgtccgaaggatgttttttaatcgatttcggacctagatcccactcttgaacttcgctatctcgggcgggcttgggcgaaaaaccgagtaccattgacgctggcataatctcttactcactacccaaatacactttggattttttaagacattatcaaa

SEQ ID NO: 6571 - DNA, 290 bp, Bacillus thuringiensis
gcacaatctatctttaagaaatatggacccacagttttttcatatatacaatgagcattgacgcgacggtatcgccagtctttctatcttcaagagttgctgcgcgcgccactatgtttgatacaatttccagggacatattgccgggcgagcactagcttcgctcctacatggcgaattacaacgtacttattagtaaaccatatgtctcatctaccaataggtaactttcaccaaactgttcatcggctgtcttttctcaattaatcatcctcttggaaaacacccaa

SEQ ID NO: 6572 - DNA, 136 bp, Bacillus thuringiensis
tgacagtaagagaatttatttcaaatggcacgtccatgagtgatcggggggggtttacttaactcgtgaggtctatcaaaacaacggcggtgccctcccctaccccagtcaacaaggggcttcatcccattcactc

SEQ ID NO: 6573 - DNA, 111 bp, Bacillus thuringiensis
tgacaggaagattttttcgcccaaacgccacttctccaactgatcgcggatcattgaccattccctaacctaccgccaaattaatggactaaacccacacctacaaaaact

SEQ ID NO: 6574 - DNA, 104 bp, Bacillus thuringiensis
tggcaggcgcttttgtatcccgaaagccgcctgctctatatgggggggctgggttaatcgctggggcattaatctcggcgtttttgacgcatgataccctgatt

SEQ ID NO: 6575 - DNA, 265 bp, Bacillus thuringiensis
taacagaaagataatcttgcaccacataaacgttccgaggggcgctttgttcgacgtgaatgacactgccagcagcacatgaccgtaaggtatcaactttactagacgctttcgtaatatgaaacttatgccctaccagatgaccacgatcgtgggtgaggggtacaatgccgcgctacatttgggacacccacatgtgaatctccataaatggatcttaccatattagtaaattcgacagctagatctttcaacgatgcagaaa

SEQ ID NO: 6576 - DNA, 319 bp, Bacillus thuringiensis
gggcaaaccctttattatcgaccccaacatcggactctcatgaggggggtgaggaaaaaacagtaggtggaaggcccactgctttacagtcttccttttctacctagactaatcttaccctcactattctgcagcgaatactatggaactcccttaatctataaaaagtcactctatacattagacgatgggttttttactatcatgactaattttcgatctcatacgtaacccgtttctctataacaagattagaggataacctaacttgcatatcatccacgtagtcttgatgatgcaacttagatgcatggccata

SEQ ID NO: 6577 - DNA, 411 bp, Bacillus thuringiensis
cgaatctgataaaggccatgcttccatacaccacgaattttttatatatggtgcctaatacagggcccgcgagagaaaattgctcacctacatccattaaatattctggcaagagcatgctttgaccagacgaaccctaattcatcacacggtgcatcgaagactaaatgtcatgcgaaattagaccgactgttaaaataagaccctgggcaatattgacccatgttggagcttctagcacccatacttatcagacgagtatctttaactcatacacggaaaaaaacacggcctgtcaaggatcccacaacttagtgccaaggggtgcacgcattaaccaccttgcaccgggcacttcagccaaaaatacaaattgttgccacatattgtgcgaaaatgtttctcaatatg

SEQ ID NO: 6578 - DNA, 200 bp, Bacillus thuringiensis
ggggggacttttgaaggccatgccacttaaccctatcaccttgcctaggggcgtacattgcgagaacatgcctctttcacggatgcccaaacataaaccgcccttcttgtcacttattcttataaggcctgcttgttccatactatacacgcgagcgagccctatttttgcaaaagtgtttatcgctgactgccaagcag

SEQ ID NO: 6579 - DNA, 196 bp, Bacillus thuringiensis
catacgcctttttttcgcttctccattattacagaacccggtgggggaaaaatgtgaactttgcttttctgacttgaaaaatgggcgatccatttgatgctctctaacttattctacaaacagattcatgaccaaaattcccttctgttgcaatagacttccactgagcatctgacttcgttcacaagcgaaacat

SEQ ID NO: 6580 - DNA, 424 bp, Bacillus thuringiensis
gtgatcaaatcacaaatccattctggaattctttatgcgttttaaggatgaccgagacacgactgcaactaagggttactataaacaccaagtcgtgggacacattattgaactctgggcacctggcactactgtatctatcgacccgcatactgatacgaaattgcctgcggagctagccacgttgatagcactagaacctctacgcggactctcaattgtgaacgccatctttaggagtggtgtctgaacacaggcatggaataaagactaatgtggagctacttagccaggatgatatggtatctgcatacatgaactaccatacatcgacatgatgtagtccaacacctaatacgatgatcatggctacattcatttagtgaactgtaagcatccgctgtaacaggacaggatgtaccct

SEQ ID NO: 6581 - DNA, 336 bp, Bacillus thuringiensis
gtgcgtccaacttttaacacctctgaatgcacgaggccactgaggagccttatgttaatagttgacgcgctttgggatcctaggtcatatacgcttttcggccccttagaagtttgggggacatttgagttttccgcccagatactggtgttgtgcgtgactgcacgatataattgggttcccagcttccttgctatgccagataccagtggcatgggtctggagagtgtgccctgcctggtggttactggtgcacgggactgggggatgctattgattactgaacacgaggatgtgaacaggaatgagccgggcacaatatttaaccatcatgct

SEQ ID NO: 6582 - DNA, 381 bp, Bacillus thuringiensis
ggatagaatccttatctactctcatttgaacactctttttatcagccgcatgacttacatgcgtgggggaatgaaatgtatgatacgggggccttgatcattcataaaaacgatgcggtgtgtgccaccattcatgagggtatagtcatttaatctctctcgctactcagattcctaaatcaagacatgaccgatcgggactcacatcaggcatgatatctctttcaacagaatggctattaccccatctttgttgtgcacctattatgcttataacatgagcatcattcataattccaaggcctggatcgagactgaccgctattatttcaatcacgccagtaccacaactgattagcttacagtctgctgaataactca

SEQ ID NO: 6583 - DNA, 286 bp, Bacillus thuringiensis
attatagagaatttttgctaccttacggcttcctcttaacctaggggtcacataggaagagaaatgggcgacatatacacaccatagtaggccagttactgtccaggtgagtcctaaaatgatacaggggataggacctgaagcctttgtatctataaatggggggggaatcgcagtgaagaatcaagagacttatggattagtgagactcgtgaacagcccttgtatacatattcttggactggtcaagttataggactagaccggggaagctacattggtctga

SEQ ID NO: 6584 - DNA, 527 bp, Bacillus thuringiensis
tcggatccacagggggtgagtaagtattggatacacttttgtcatttataaagcttttcattcggatcaaattttttaaaggccatagaggaacaaagcaccattagggggagcacaatgggaagccactattatcacgagtatggcacatcgaatcctgcaacagatatctaaaggactagatattgtatattaaacacaatcatgctttccatgtttattgcttgcacagggagggccacaactatgagcgcatttgatacctgtagaaaaacagaatgcatgtactgtaatactcaataatggtgctgattgattataagctgccatttgataatgggttatggacgtaatcacaagactatggcattgtttacgcattgcgagaatagtatgaccattttacaatgctgacagactctaataagcctgcttgcttcataagccatagataactatagaccacctattgagctaacccagctctaagctggagatttcctacacatactccaacttgaaagaca

SEQ ID NO: 6585 - DNA, 175 bp, Bacillus thuringiensis
gctacgcctaaattatctgaagttgctcaacaactcattgagggggctatcaaaaacgataagtgtaataaaccctcaaacaccactgctatctataaacacgaaagtactatattttttaaaaatgctacggatcttgctagtgctactggtcaaaatactgacactaaccttg

SEQ ID NO: 6586 - DNA, 218 bp, Bacillus thuringiensis
ctcggaagcttgtctcgaattcgataatacccgattatacttcaacatcacttaccgcaacctgtggggttgtccaacgcaggaatacgcatgtcatacagataattgtttatcttgctcccgaaaagtcgccgttagcttgcgccagttaatcatacaggccaaaacacggactaaccactaactaagtcgatccagcttttattataagatgaaga

SEQ ID NO: 6587 - DNA, 253 bp, Bacillus thuringiensis
cgttgaatgatgctggtttttgttcacgttctaacattctgtacggcctaggggcgatgcaaatgatgttaataggatcgttagatggcgagcaagcaattggtattgcgacacattacagggcgcagacacgcttttaatcaacgtgtattaaagaaatgctgcagcgaacgaaatatcaaaacacaccagtactagcgatgacagttcataagagccaaggaactgagagagatatgatgatcttcgatac

SEQ ID NO: 6588 - DNA, 481 bp, Bacillus thuringiensis
gtgattgggacatggctgactacatagtacaacctaaactacacttctaaggcatgaactaagagagtccctgatataattacatgaagagccctgattactgactatatcaacatgtacctttctacataccgcatgggaactatttaaactgctagaagaacacacttcggagaatactaccttttacgattatgaagaaaccaataacgccgacgagtctttatggagagtatgttcatacgagataaatgtatctggtgctgcattcacactagcgctgtctgtccctagattatgtgcttacggactgacacacctactcatgggacgagcatctattgctacaggcccactgccgcgttacttgtaacagccattgtctgccttagccggattcccattgtatatgcgtggacaccaatgcttggtcgctcacaaaaagcggaacaccgatctagagcttgtggtgggaaccctt

SEQ ID NO: 6589 - DNA, 376 bp, Bacillus thuringiensis
atacagcagatggaaaccgatcagcattcgaagagactttcttatcgccgtgctcatggactgaaacaaccagtgtcctttcgacaccaccgcaccgaaggcgcttgcgcatacgggagactgtgtcgaaaaggtccttatcttcccagaaggaagagcctaacagctgtcctgacgatggtggtgacatcatcacggctgtaaccacgatccagatccgtggaggatgcaagcgctcgagaaagattgatcaactgactgattccgaaccacgcacaagcatatcaagcaactgttgctggtcatgcagaggactacagcaacagtcagggagccacctgcactgttatgatgggccatggagactcagagccac

SEQ ID NO: 6590 - DNA, 286 bp, Bacillus thuringiensis
taccagtaagggcaggcccggatacaaactggctttttttttcagaaaaaacttccacaaacagacgtgaggtctttgacggcgtacttgcagccaacaccttacgcgctctacttgaataactccctgtccttgaacattagcttctcggcttagagcctgcatatcagcaacccaccgaccatgctaaaggacagcccagataaatgaattattaccaggcacattcatcttttgatgatgctggattgacagtgccggatacactaaatgtccacgagcaaca

SEQ ID NO: 6591 - DNA, 366 bp, Bacillus thuringiensis
ccacaaggaggtactgggcgctttttctttcctacaaccgacgtggctacaagggggttatcctcttcggacaccgccttgcacaaagcggttttttccactcagttacctcgcccttgtgatgcatgcttaacatttcatacacggtatacatccaaccgaatacgtgaacagtgctgcaacaacttcacaacttcactaggtacaggcgctagatcgcgcgcctacatagctgcctgaggcaggagtttaactaaattattacacgattctgtatgggtacataaagctcgggctggctacgcttcattaaagcccgttaccgtgctaaccatgctctctaacggtgcaaatagaccgaagttc

SEQ ID NO: 6592 - DNA, 407 bp, Bacillus thuringiensis
caggtggctgctcacttgtccaatgaaaagagacatctttctgatgggaacaatgcgatgatacgacgtgggctctaccagcatttagatgaactgttaaaaaggaaaaagcatggacaacgatgaatacattcttttgagcaacagagggtgcaacaactctgtataacgaacatgtttcttttgacgagaaaacatttgcagcgagttgatgtgcttgagaatgattgaatccaacagttacttatatagtggaagatgctccgaagggctggctgaaatccattaagacagtgcgagatgagatgacgcacgcacacgtgcagaaggctgtattacggagctacctacacgttgagatggaccatcatagagatcctgatcttgtataagatgcacttagcatt

SEQ ID NO: 6593 - DNA, 329 bp, Bacillus thuringiensis
gtatgtccattttttaaacgcccgcaggtacgattccaggggggaatactattaaaatcggaggcacagggcaggaccctcaatcataaaccgctgtgggaacactgcaatggcgcattgggaatgatcttacagagtggattatgctcttaagcgggagagcaccacacaaatgattacctatcttcatggctatcccaaatacgagtggcatgcaactgatgagagatccattcatggtagtctcctatgctcggcactcggcgaagcaactgaatacggtatacatggctgcgaaataggaatgtgacggttaaaacacttatcca

SEQ ID NO: 6594 - DNA, 100 bp, Bacillus thuringiensis
ttttgcctacatgtatcagtaagacactaggggctgttacttgtggcacgggcgctattgccactagcgtaaccacacttacagctcctccccgggctct

SEQ ID NO: 6595 - DNA, 338 bp, Bacillus thuringiensis
atatgaatggatggcacattgagataataccagttgtccgttacgcagccgtagcgcctgcaatgtgggcatctaataataccgggcgctctcccaatctcattgagagcgaccttatcgctaatctctttagtaacgaccatgctagagcacgcaatggcctgttccacggttgcttttatgaacactaatctcaaccatcttcgcgcgtactcggtcatatatgagcgccaatgactacatgacattcctccttgaagcaatttctattgaatttataacggtttacctagacaccaaaaatcgcatatatgatgtgcgaaacgatgcgagaaaaa

SEQ ID NO: 6596 - DNA, 459 bp, Bacillus thuringiensis
tttattactatatcggcgcaactcgaatcatatttttgcatttctctgatccatcgacttaccgggggtaacttcaaaacaagagcgggataatcatatagagggctcttactttatctagctgcagctgctcgaaaggctctaaacaaggatgatattatacaagcttcacatgctgatcattgtgaatctctcatcaacaaagggactgcgcgagccgattccgtttttatatcacctaaccgtgcagcttatctaattgtaataatgttggtaacactggtgatagtcactatggtcgaaaactggagctactgttaatcttttaaaacattggctcattaataccgaagtgtgttatagctactatggacctataatatatgctcatatcaaaatgaacgctgtttgcatcgaatctgttgcaagtatatgagactgtgcaaagacctcattgta

SEQ ID NO: 6597 - DNA, 284 bp, Bacillus thuringiensis
actcaaccactatattttttgcgtcatggcaagtggagggtttttgggggcgcctaatactcagacgtgcgcatcgacacatcacggtaccatgtggaatacctttcaaggcccttggataggagggcggggtggaaccttctacaaatgggacagcgcaatcgtcaacagcaggaccgttacaaacattgtcttgctgcttgaccatacaagacttaaacgctccagactgcctctcctcaaaggatacacgatcgcaatttcaattaacaatggactaaatg

SEQ ID NO: 6598 - DNA, 150 bp, Bacillus thuringiensis
acatatgaatggaggctgggggaatgccgagctaacactatcatcatagtatgtcgctttaattacacacaaaaacgcaatgactaaaaaagcaacacgcgtaacaattattgccgtgtaacaattagggaaagaaagtattccatatac

SEQ ID NO: 6599 - DNA, 351 bp, Bacillus thuringiensis
ccgtgatatccctccggttacattctacataaccccgacgtcttagttgcagccagaacatgctgcccaacagagggcctttcagcgtacgggggcgaatccatatcaactatctccgcgtcaccagggacaacagcaggaacaatccatcgccttctctctactcgagcagcatgatttacccgaacacacaatgaacaaggaacaatagtgtcagcatccataggaatgcacaggacatgcgtgatactctactgaactagtcatagccgaagaggccacatttatacattaccaccgtacaaaactactaacgtgtgcatgccgcattcgtaacaagacactatgaat

SEQ ID NO: 6600 - DNA, 113 bp, Bacillus thuringiensis
ttttggtactggacaagcattctaacctcagtggggagtattaagtgctcgtggcggtgctgccttcccgtacggagaatggtacaggcaatagggtttcagcatttgcatgc

SEQ ID NO: 6601 - DNA, 330 bp, Bacillus thuringiensis
ctgagatggttaacggcttggacgggcgcagccaacggagggctcactctatccgtgggggtccgtccattggttaaaccataaaggggtggaccaggaatatcacacgggggggcatatgctacgcatgtcggactagcgttaagaactgactcaccttgagcggtccagcctacctcatgaagcctgaggcattccgtggacggcatactgacccgtgttgcattgctgataccggctttcgtacttagaagcactgcaccagtccttaccgagtgactccattgatcttagaacgcttcactaccactgataccattaggtgtctgt

SEQ ID NO: 6602 - DNA, 171 bp, Bacillus thuringiensis
actcaagcaagagcgagaccgcaccgctcctttacacctgcaggcttgtatacgagcccaaggtgtgcaaaaggcccaatgtttgcggtctggacaggatgaccccgcaactgagggagacagggggcttccggaaaagcagggggcggcgaatctgtcccaggccctggt

SEQ ID NO: 6603 - DNA, 205 bp, Bacillus thuringiensis
tgccccacaaatttgatatataagcgcccaccggtcctcagggggcgactgaaaagaccagggagcgtgtgattctaggtgtgaatgcgcacttagaagctgatgggcgtgggcaccaggctgtacaggcacatacactggctgatgatgcctatgtagcagtgacgcacacattgggcgacatgccagacccaccagattaccc

SEQ ID NO: 6604 - DNA, 337 bp, Bacillus thuringiensis
ccccagggggtgattacccttactccccaattcttattccctcaaccttttttatcaagcttgaacagactcactcatgggggggattttatacatccatgggggccatgcttaactcaaaatagaacatgtgatcaacaatgcctcaactgctagaaaccaaaaaaagccgcagtcgttaaacacttaaactattcatactgatgacgaggatctctgataaccatactactttacattgaactgaactatatactagcctcttctgtaccattttagataatactggaagcatcatctgactctattaactacatggccaaatggccaccaccca

SEQ ID NO: 6605 - DNA, 150 bp, Bacillus thuringiensis
ctcactcgaaggtgtttatacgggtatccacagattcaggggaggactcatgaaagaacaggtgcgcaaaaggccagcttaaggtcaggaaccgttattaggccgcgtggctggtgtttttccatctgatttcgtcctcctgtctatgta

SEQ ID NO: 6606 - DNA, 352 bp, Bacillus thuringiensis
ggggcattatgctacctaatctgagctggtgatattttttagaccaaatcaaaagcatggctacgggtactaatttcgccgccttgaggaataagaattaggcgccaagctatctcattgactaactgacgatgtcaataagctgctcggggagcaggatactgttgaatgacagagctaactctgtttccattgtagggtacatgatggaacatgaagcctgtaagtgcatactagtttgcgctaagctaacgcccttcattatacttgaaatataacagacgcacgcttcaagtttactcatgaacgtaatctctacgtacttggactcagcatatactgagctgtatat

SEQ ID NO: 6607 - DNA, 116 bp, Bacillus thuringiensis
aggaaaacactaaacgaaaccacaacagacaaaccagctttaaaaaaaagaagaccaaaccgcaacgagggggaaaaaaaagaatgagcgcggggacaaccacaccgcaacacaaa

SEQ ID NO: 6608 - DNA, 317 bp, Bacillus thuringiensis
ctgccgccactttgtaatccgccaaaactaccgaactctcaatggaactattaaaaaatgggcggcccacggcactaacagaagtcatagcccaatatgggaacactaggataatggctaggaactgactaatcggtgcttatgaatatgacatggaggtaagcacatgactccagataacctcaccacttgggtcttccgcatgagggtcgattgcttctgtactgaggaccatacaaggaagtgacccttgcgggggactagccgcagtaattatatactgcatacatgggcgagatatgccatgagactgaaaa

SEQ ID NO: 6609 - DNA, 487 bp, Bacillus thuringiensis
gtgatgctgctctcatacatatcatatttgaactccggtatgtaccatctgatgcaatgacaaatggaagtcgtctttaaaaaaatagggtgggtttacaccacaatcatatgcatggcaccattttgtggtaatctccatttgcagctcctactggaatagcatgacagcggtcggaactatgtataacacctaggaaggagtgctagaaccaattgtcactagcagcgttcattattatgactcttctaactgcctgctatctcgcccatacttcgaacgtggatgctcataagcatcatacctaagctaatctatatgttcagaaagaggaaactcagtaacttcatatatctaaataagggctgcgataaaaagtgttctagtgtgctcgaacgctcctttaaggcaatgcgctattcattctcatgttcgaatcgtttggagactaaaccaactaaagaccacttattaacactaactgcat

SEQ ID NO: 6610 - DNA, 309 bp, Bacillus thuringiensis
gccgccggttcgccccaattttcataagggatgtttttcgtgactaattcattgacacaagaacgggaaagtgtaaatacaaaggcgccatttacataattatgacgggcagctcgagccgtacgacatcagccgcagataaccgagctgatagactcaggagcagtaaaaccaccatctatatggacaaccctctgtcactgtagacgcatacaatacggcctattcggcatcagagagtttacggcaccctgcagcgcatttgattgcattaacacaagcggctacaggattgactgaattaccttg

SEQ ID NO: 6611 - DNA, 423 bp, Bacillus thuringiensis
actcgggctacaatcctatattctgggcgcttttagtgcttcttataattctcaatacgtgggcaaatgtcattcttgggtggtagacataaaaatatccacacttatggttgtcacctcatgcagctagcggggatgccttattcgtgcaagaatgagggggaagaatgggcgcgctgggcgcgcagcatattaacttgaggaaaacagacgtcttgtcacgacattactttcctcctgggtccttacgcatctggcctaaccctattgttatatcacagacatgctacttgatacgctttgatacataacgctgatgctgcttatcgattacataaagaggatgatcatcaggagcccacatttccgcgtggacataatacccttatttgcagtcttctgcctctctgattttgctcaccc

SEQ ID NO: 6612 - DNA, 160 bp, Bacillus thuringiensis
gttaaaccggaataacgtgtggcatgtatcaccacttctgaagcatctgatatgcgcctaccgtattatcccagaatgacgcccagcaaaatcctctctgaaagccttaacactattaggaaactgccttgcttgctcacgcatcatttgcaccaatgac

SEQ ID NO: 6613 - DNA, 295 bp, Bacillus thuringiensis
cctaatcccggtcaactactgtctgatgacatgatcgtatggaaaacatagaacgctcagacgggggcgtgataagacaagcacagttagtagaaagattgcggactgaagttacaccgctacttataacaatgtttcactagaggcactggatcattccttgcgcgtaacggctcaagtgctgtgaactgagacatcgacatagaacgcggcagtgaatagctgaagcggttgagctgcaatcctgccgattgaacatgaccagccaggataccgagatgccgaccggtcatcg

SEQ ID NO: 6614 - DNA, 489 bp, Bacillus thuringiensis
ggctggtagcctctagagcggccgcccttttttttttttttttgaaacaatattttttattcatcctatatatacagataatttgatctatcatctaatgctgatcgctatgtgccacgcccacgctacaaagaaatgttacaacaattcttctcgctccattcagggcagagaactcgtttatgctataatgtttaaagaaaccacaaagtatacaacatcaaacaaatgcccaaatgacggaaatcttggatcctcaacctttgctacacaggtttctttcgttccaggttctaaaattcatcatcatcaagtggaaactcatcatctggcatcatagctgtcagcagtgagtatttcacccgcaatgagatcttactcctctcaaggttcaactttgcgcctgaaaccacccaatagcccggtgagtcctgcggcccacgcatatctctgttggatcaacaaatttagcagtttggggtctgcact

SEQ ID NO: 6615 - DNA, 146 bp, Bacillus thuringiensis
aatatgtaactagtctaagccgtttttcatctccagggtgaagtgttaccgttgaacctggtggaatatttatacgctgtccaattgttacactgctgatcgaatctttatgccttatacccttcttaaaagcgtaattgagatcc

SEQ ID NO: 6616 - DNA, 102 bp, Bacillus thuringiensis
ctgagtttttttgtcactatcgtgtccaagtagcaggttgtcaaatcactggctggtatgtacgatctgataaggaaacgctgctctagacactggaaatga

SEQ ID NO: 6617 - DNA, 142 bp, Bacillus thuringiensis
ttgttttattgcctctagaaccaaatatagaacatttgggcgaggttgctgttttagctccattcactaaatataacccaacaccaagtgagctagtatttttaggaatacaaaatgaagaacaagatttgcatacgtttgt

SEQ ID NO: 6618 - DNA, 661 bp, Bacillus thuringiensis
  unsure (1)...(661): unsure at all n locations
tccggaattcccgggtcgacccacgcgtccgcccacgcgtccgccgcatccgcgccgcaacccgcattcttcctgcaggcaaccgcccgcatccgcggcagcgccgcggctgcttccatccatggcgccgcggcttccatcaatcgccagcgcgtcctccgtactcctgtcatccgaggaaagccttccatccatggcgccgttgctgcaattccccccgcgatccacgctacctccattgcccacacgatccgcgctccctccattgctaccgcgatgccccttcccaggaacccttccatccatggcgtcgttgctgcaggtgccccgcaatcaactccattgccgccacgatccccttccaccgacgacactcaccttccatcgacaaaactgatcttcctccattccaccgacggcactcacctctcagatcccgtgctcatcaccatcgtgcccctcgctcgccgcccccacctcaccaagagccttagccgtccctagagaagacacggaggtgcagtgccagtgctttcctaagtgcacctcggatttcggtaccggccagattgggacgaattcaacattcatcggctccaccaaacactgncctatgatgtgtatgctgcgtcagacaggagacccaaagtactcatagatg

SEQ ID NO: 6619 - DNA, 467 bp, Bacillus thuringiensis
cggaccatttccactgtagacttcgagcccctttcttgttacccatgggccgcccattaccgccagggaaacttggagccttttcgctcatgctccaccgttaaatgactttgcttctggagacatgaattatttcaaggctttctactaataaagaagcaaaaactacaatataaggaggtttgtgctacatcctagggcagtccgatctacccactctattgcagacatttgacccgaagttatcgaaataggcagcgcctttactagctgtattagggacgtaacagcaagctactgcgcatcatatgagaagtgcagaccactatatggcgggataaacccatacttgaatggcgatacaagcattcaacataacccttctaccgatgggggtacaagtaaagacatcagaaaagcccaacgagttttcctaacttaagaccaaatcgtcaacaaacactttt

SEQ ID NO: 6620 - DNA, 250 bp, Bacillus thuringiensis
actaggaatttagcaaataatcaatccgcataatgatattcaataacgattttacgatacttttttgtatagtttctttcttatgtctgataaatataatatttcgtatttcagctcactattgtatgctcccattttatgtccgcacagcattctacaaggagcctgccaacactaatgactggaaaaaccaaacatctctcacatgcattctctatcgtcaggaacacgcactagcctagcttctcta

SEQ ID NO: 6621 - DNA, 411 bp, Bacillus thuringiensis
gctgaatcaggaaaatataataaatgaacgaaccctccgcgcacccaaaaaagcccccgcatcgagaggatttatatcaatgctccgccaaaggctcgccctcacaaaaccgacaagtgcctctccaactcgcactgaagaaagctctacagatgcaacaacgccatttgcccacgccaccgcactagctaaccacaatgcagaataaccattagaaggtccgatccctaaaacgaccactgcgctacacccttatactaaaactgcaaaaaacggccccaccccacgaggaacatcccgcaacttctccccccccagctccacaacccgatcacgccccgccccacaccgcaccaagctgaacacaaccacccctcaccccccgagagaaaaaaaaagaaaaaaaaaaaa

SEQ ID NO: 6622 - DNA, 204 bp, Bacillus thuringiensis
aactatattagattgcgttctgaggtttttaagccactaattcatccctgggattagttgattcctcttaacggtgctcatgattgacaaactgttcccataggtacacactttacttgctttgctcatcaaaaattttaatgatacgctttaacgctattttacgtgcaactaaatttattcaaatctgcattaaatgatttt

SEQ ID NO: 6623 - DNA, 102 bp, Bacillus thuringiensis
acagcccaaaaacgcctcccacggggagcactgtcaaaaccgggagagcaaagacccacccacagaaaaaacgaagatgagcaaacgcaccccagcaaacac

SEQ ID NO: 6624 - DNA, 216 bp, Bacillus thuringiensis
aatggaaaaagattcttccggtatgatgattggactaattattcgattattagaagagaatcgcgggtggagttcagttgaaaaagagatacattccgataaagaagtttgatttagtgaacggttccctgcatgggtaggccaattaagatgaaattacgaaggccaaataagttttcgaagactgtaagatcgtacttcaccactggacctcca

SEQ ID NO: 6625 - DNA, 315 bp, Bacillus thuringiensis
aatggaaaaagttccttccggtgtgatgatagcattgctgtacgatcatcagaagagaattgctgggggagttcagtttaaaaagaggtacatcaaaatatagaagttgatttagtggacgattagtgactagggttagtaaaattagatgaaattagaagggccgcattattaaacgaagattgtaggatatatttaacagagagggttgttgccagtattgttctttgagtgacagacaaattattaacgtcaaaaaattataatgagattacaatggagaaatatcaatatgcactatcaattttacaaatg

SEQ ID NO: 6626 - DNA, 299 bp, Bacillus thuringiensis
taatggaaaaagtttcttccggtatgatgactggacaagctttatattattagaagagaatcgttcgcagagggcgggttcaaatagagatacatttcgatatagaagtctgtccagtgtacgatttgctacaagctcagttaaaactatgatgcaattacaattgctgcattattaaacgaagcttttagtatatattcaacagagaatgtcgatgccagaattggtcttttagtgacagacaaattattaacgtcaaaaaataatcatgagattttaatggtgccatttcaatatgc

SEQ ID NO: 6627 - DNA, 310 bp, Bacillus thuringiensis
tcgggaatacatacttgctccaaccaacgacttagctgaccaaaccattgcaattgtcctatccttttttttattggaaacttcgtagaacacatcattttctgcttttcttacatcggcactggccttaggcacgcgttttaacttttcactggaggggccaaatagtttttggtggactggtaacgggcgcttaacgccggaccttccagttaccaattctattcggtataaccaccctcaattacctattgtccttatttttaaaatagttaggaaatgccttccacttcccattttttatggaaac

SEQ ID NO: 6628 - DNA, 146 bp, Bacillus thuringiensis
cgccacgacatcaacaaacctatggtggaatgatatacaaagcgtcaaagatgatgacagtgaaggaatcactatacaggaagagcttgaactagtatgcacaattacttaccgcgcccagttagagcttcgattttgatgaggcc

SEQ ID NO: 6629 - DNA, 183 bp, Bacillus thuringiensis
tttttcgccacgacatcaacaagcctacggtgggattattcacaaagcgtcaaaggaaatgacagtgcaagtaccactatacaggacgagcatgacctaggacggcatttcacgaatacgcgaggtgagagctgcgaaatcagatgaggcactagtaactggaaggcccgacaacaactggac

SEQ ID NO: 6630 - DNA, 486 bp, Bacillus thuringiensis
gggacgacggcggcgtccgacccattgttgtgaccaagccaatcatgcgtgttttttggctgagaagaacaatgcgaacagggagcggaaacacggctccgtgactggcacggggggcagcagtggaaaaatgtggacagtgggcgaatgcccgatccagcaatatcgcgtgagtgaaaatgtggatgccgcttgaaaagctctttcgcaaggagaacggacagaacatgactcgtcacctcaggttttaaatgaatgggctcatgagacggggaagtggttaggggatgtgaagcaacaaggacgacagaatgagaagggcacgatagcggagaatcgggttggattggatgccagtaggatatgatgcaccaagctaacgggctaaagatatgaatgacacagaagagaccccaaaatccccaaagatttttgaagtgtcttcttaatcacccaagatcaattcctctgtcttggtttgggaat

SEQ ID NO: 6631 - DNA, 234 bp, Bacillus thuringiensis
ataaatcttgtttgacgctctaaaccaactactgtatttttcatcctaacaaagtctttcgcaggggcggtttgccaaagtactaaagtatgaacccgcaacggagattaatttttatgaactcttccgataatgtccgttgaacgttgatatgcaccgaacgacttctacacattgaggggctaaacctaaatgcgctacagcaggaattccctgcgttcgctaaatattgaa

SEQ ID NO: 6632 - DNA, 405 bp, Bacillus thuringiensis
ggctggcagccatactcagctacgccatggaatgaatcatttgataaccctctcgatcactctcgtgcggaggacgcgataaatccctatgcatactacgtaaaactacgtttaggaccctctggcaataagccgccttaatgagtgtatcgcgcccgtcccaagaattgttagaacatatttaatgccccgcttagtcccattgtgagatacaacagactgaacgtgcacacaggagcaggctcgtgcagcgaaacggagaaagaagagatacggaagctagcaaagatccgcttaggtccaaacctacttaacaatcactcactacaatcacgtcagaaggtacgcgtgcagggagtgacacacaacgtgcatcataggattggccatcacgggaattaagag

SEQ ID NO: 6633 - DNA, 274 bp, Bacillus thuringiensis
cattatttgtgctgctctggacttctgtatttggggtacaagatgtactaacggtagggttgtaaacgagaaagcgagtaaactatctataacttgtgcgaaagggggagtgataggggcgagataggctaatgtctctatctacatggttatgcatctcgggtgttaaaccagcgagagagttattgagtatatgtgagctttacgctacacaagtggaaaagcgtgctcccatactaaagggaatagaaggatgaaacagaggtaataaatg

SEQ ID NO: 6634 - DNA, 108 bp, Bacillus thuringiensis
gtacacaatttccacacacagcctaaacaatatcaatttatctataagcatgaggagtcgagggggggttgacaattatactacattcagaaccataaacgatgggct

SEQ ID NO: 6635 - DNA, 524 bp, Bacillus thuringiensis
gcttggatcctctagagcggccgccgtcgctggtaagccaccggtgcagaggtggccgctattatcggtgctgaggtggtcgccgccgctggtgaggctgcccgttgcagaggtggttgcctccgctggcgagaccaccagcgccacctgccaccaagcctccaactctttggatttaatggcctcgttgtcgccccccgtaggaggacgggggcgaggacctcttcgcaatggtgcacacattgaggcggccatcactgttgttacgccgttctagaggattgcgcaaggacagtggtcgcgggctttccagcgcgactccgctggcgtctagtagtttatacctgcagagtagaggtggaactaggattccgcttgaaggcgaatgtaatacttttgctttttgtaaggtacttttgagtactatttatcaagcagtgttagcacttatctgtgaccgcatgttctgctatgtggatgttgttgactcttcctggacctggcccccgttggatgcagcttga

SEQ ID NO: 6636 - DNA, 289 bp, Bacillus thuringiensis
cgtgagcagaggggatcccggcgccataagctgcaaattattattgattctatagacacctcgcttatgatggtccatacactagccttctagtggtatacaaactcgctatttctaaagaagaagcatcgacacccacagtgatgcatggattagaacagcttaataaagtaagtgtgggaacgacagcactggcacatgatgattgaactgcactttgtgcacgtcgtgcgtttattgatacgctagatagtactgcagatgatgcaactacggctattaccgcatc

SEQ ID NO: 6637 - DNA, 253 bp, Bacillus thuringiensis
gaatggacgaagtgttttgtacccggtgatacgcacacatagggggggggatagttaacaagcggatgcaccatcgactgggggctagttaatagggacgttgcactccgagtatgcactccgtcaattgttatcacaagtaaagtcaccggtttctgtaggaagattacgagcggtagcatcaattgtttataggccagctgaaatagcgcatgcagcacaggcggatgaagcttgtagtcgaacagaggaa

SEQ ID NO: 6638 - DNA, 235 bp, Bacillus thuringiensis
acgggatcaactagtgcattgagctgtcgatgacacttggtgttttttatgacgacttacaaggacgtaggggagggtacattaaaggaggtcaaccgtcattaccaggggcggcattaggagtgaccgtgacgtacgaagacgcactggcacatgtttgcctggaacaatatgcactgatttgcgccgatcgtggaagagctgaactggcactacttgcgtatccaaacaaaaa

SEQ ID NO: 6639 - DNA, 240 bp, Bacillus thuringiensis
gacgtggtgtaaatactaatgaagaactatctgcaacacgtctatttccttccgaaacatgtcctaacaaggatgggtccttttttaacactctttcgtttgtatccctgcaccacttgatactagctcgatcgcccgtgaaattaggaccgcagatacacgtgcatgccacatactagctgtcaactcttatgaagatgccggttcatgaactggctgacagcgtttatattggtaaat

SEQ ID NO: 6640 - DNA, 172 bp, Bacillus thuringiensis
gaagcaggcgacaattagatcaaagccaacccattgataacccgcagaacagcagccagcaggggggcataaaccaagaagcagcgccgagccacgaaaacaacaaaagcgagacaagaaaagaggacacagacacaaatggccacgaagaaggaaaaaaccggacagccaa

SEQ ID NO: 6641 - DNA, 476 bp, Bacillus thuringiensis
ctaacaaaaagcggattggctataagcttacctttgttcatttgtggattcatagcaatttcgtttggaaaggtccatagcatcgatgcctcaatatatgtatatgagtctgatcggatatcaaatcgagtgttcatctctcgctgcattttctatcatactgtgcagaagtaagactaactatgactaatactggtatatgaaatacctatgctaggtacaagtgtaaatgcttactgaaagtgacagcaggggataccctcggtatatagagtgctcaatacatgcaagacaggattaaagaagatgttatgtttcatacggaataggacaaacgaagagtgcgatccatctatcatatataagctattaatcgaagtttgttgttacacattctagttcgtatactctctatataactagcgcactaactatattggaggttgtacgtataatttaggctagctattgcacta

SEQ ID NO: 6642 - DNA, 274 bp, Bacillus thuringiensis
cgcacaattccttttctatgctattcgaacatgtgtcgatatgaataaaaggagtaactgagtggggctgctgtaaaagacatgctggtttcgccagctggcgtaaacgctaaagggaaacaaatagtcgatcgtactaacggtgggaaatattataaaagtaatttgaattagaagcgttaatatttcttggatatgagaaatgactttttgtggaatcagctgattcatttgaaacagagtggataggggtactagccgttgttatgtatag

SEQ ID NO: 6643 - DNA, 223 bp, Bacillus thuringiensis
tcggatcccgaatttgggatacattaccatttgcaatatcttcacgagcaggatttctccaatcatctttactggctatagataaaggaggtcgacatgattttcaccatagatagcactgaggagggggatcatgatataatacagaaatgccatatcagtaatatgcatacctataacagacatcgatacttgctagacactgcgaacgagagcactggac

SEQ ID NO: 6644 - DNA, 577 bp, Bacillus thuringiensis
  unsure (1)...(577): unsure at all n locations
cgtaagcttggatcctctagaggcgggccgcnncctttttttnnttttttttttcttttattctttttctttttctttcttgttttatttgtttatttgttttgttttattttttgggggttttttttatttttctttgggggggttttttttttgtttttttttttttttttcccccccccaaaaagggggacccccccgggggggggggggcccccccccccaaaaggaaaggttttggggccccgcccccaaaaaaaaaccccccgggggggcccggggtttaaaaaaccgggggacccccccccccaaaggggggggccccccggcccaggggggaaagaaaaaccccccccattttggggggggaaaaaaaggcccccccggagcaatttggggaggggagcggggttttgtcaaaaccccaacccgggccctcaccaaaaaaccggggggggggaaaaggggggggaaccccaggttcttttttatagggggggcaaacccccgggggggaattttgggggcccccaccccggggttttggggggaaaaaagggcccccccccccccgggg

SEQ ID NO: 6645 - DNA, 275 bp, Bacillus thuringiensis
gatgcttacactttctccctttaaatcggagagtagattcgtaaccggacaaaacaacaatactgcgtgggttattcaaaaagaatggattgtttctagcgcccgaatcagtccagttcttactacgagcatacaggcttttcataataaaaacgaatcgtgtctcgtacaaccacctattcatcctccattttccgaaatggtcactacaaacaacaggcccaatctgcggtgagttccattcccagaaacaaaattgaaacactatgtgatag

SEQ ID NO: 6646 - DNA, 404 bp, Bacillus thuringiensis
acttacatatgatgagtaacacatggtagttaatcctctaactgaacacctaactatgggggattgaatgcctgatggctgctgttttctcgatccataactctgaattgtgtcataacctgaatggctagcgtactctaacattagactaacatcctctgcttgagtcactcgaaacgggattgtagaaggtgtaccacccacagtctaaagtatatacgctacatatagggcacgcacttggtcatcactaaactaagattcatagaaaggtaaaaacacttgcatgtatatcccagacactgaagctgcattaagggtatgcataatgaccgctgagcatggcgctgataaatgttcattcaatccctcgactaattagtgcacaccgtgagacattacca

SEQ ID NO: 6647 - DNA, 137 bp, Bacillus thuringiensis
cccgccaaggcacagacggggagaattaaagagcacaagggggggacacccaccccacacgccaaataacaggaagcgaacgcaacgacggtgacgaccagggaagaaacaaaacagcacaaggaaaccaaccgcag

SEQ ID NO: 6648 - DNA, 222 bp, Bacillus thuringiensis
catgatacatcctaaatccaattccctgacacacctttatttatgtacgaagaacatactggtatgggggggtttttttgaaaagggctgagcattgccataggacaaactgttgtcaacgcactacacgcctacacaaatatcataggcagacccaaaagaaatcccatttacagttgaagagaacactcaaaaggcgctatcacataacacggacactgg

SEQ ID NO: 6649 - DNA, 109 bp, Bacillus thuringiensis
gctcagtgatcaccgaggatcctcataaagggccacattaacaagtttttttagcgtccccaaataaaacaagcacatttgcggaatgcttcctcatctacatgagggt

SEQ ID NO: 6650 - DNA, 130 bp, Bacillus thuringiensis
actgcgcggcaccaccacaccggcgggggttattgacagactacagggcgcgtcacctcgaacttacaagagaaatgaccgcgaaaccacgatatgacgaatattggaacacattcaaaactatattgca

SEQ ID NO: 6651 - DNA, 196 bp, Bacillus thuringiensis
taacaacacttcctaataacgaagacagaactccatctgattgcccaactgtaactaacccaatgtcaaccagcaacttcgctactttcagatgaccattccatcaccctatcttattacccctctctcaaataataagcatcaatatactccctctttccaaagaattctaaatatctgaaaataatgcatcctt

SEQ ID NO: 6652 - DNA, 124 bp, Bacillus thuringiensis
atacgctctccttaaatcaagcaatagagataagggagagcgggggcttctttacatatcatcgctttcgtccgaaaagaacgcagctctacatacggcaagacatgaaatgaaaacagggcat

SEQ ID NO: 6653 - DNA, 363 bp, Bacillus thuringiensis
gaggctcgttacctaattcatacagaaccccggtaataattactataactactaactttgttacaatgggttacaacgaccatgtaccttaagcactccctctaataaaggacgctgcatgtgcacaactacaaatgaagctaatagcttagtaagagggagctactacagggggaggccgaatagggcctacaagatctacaggaccatggggtctttcatcagatttaacaggcacgacaggagactcatgatcggcacgagcactacgtgtaacaggtctaaacgaatcataagacgcgagaactgcactgtcgccaaccacgacaggagcggcagggacaacaggggcaacaagtgcgg

SEQ ID NO: 6654 - DNA, 393 bp, Bacillus thuringiensis
tcgtcacctaatgcatccactaagcaggatatttttccccattaacgagtagcactgatgacagtgaaaatcaccatgttctacacggttttcatccaattctggagagaataaataatgcgctatcttacactctgaaaagcgctagctatagttctaagacatacacatcaactctatataaatcttccacagatacatgagatggtgcaggcgctataactggaccttctaagaaaagagccaccatgatcatgcatcacaacaacgtcaccaactggactgtacccgtgcccttgcccaacatgttgataaagatcaaccatgggtggaatcttctattcactttgagaacgacaaggtgattaaacatcctgctagccattaaacata

SEQ ID NO: 6655 - DNA, 292 bp, Bacillus thuringiensis
aattcgcgggaatttttggaggccagttcataaacataagcataggggacggattctaaagaaaacggggactgttatagaactacacagacttcagctaactatagattgcggaacagaaaccacgtatagggatgcgctaccagatagaaggtgtattgatacgtccgaacctcaaaagacaaacggtatgttaatgagcaaggggatgattcatttcactggtaattgctagcgcaggcgttgagggacaactctggagcagaatgcctcattaactcaaggccaaaat

SEQ ID NO: 6656 - DNA, 169 bp, Bacillus thuringiensis
cttcagcattatgaatttgattcataaaagaagtatataatttttttaacatttgctgagcgttagcaaattctggatagatgtcatcatcacaagacttttggacttcgacagcctcattaacatttgcagcacaactttgtaccgttcgaaacatatctaaaatctt

SEQ ID NO: 6657 - DNA, 419 bp, Bacillus thuringiensis
atgcatacaacgcatgtgggattcaattagtaatcataatgaggtcatccacacgggctttactggggcggtccacttaccgcataaagggctctccaccagtctaatagactgcatcacgtgaagctctcatgagcgagaacgtggtgccatcctcacttaatattcgccgtcaccaattaggcccgatacaatgagctggatatgcatatgctttgcttatcagcgagactctatacagaaactccattgttctatgtagaatacacacctgcatcaaaaacgttgaccacattctataaatgaaagttgattctaccattggacttatactgcggggtttcttgcacgagggactcgaataaagcagatgtatctgcttgatatgatttttcaggcactggttgtatacattgtaa

SEQ ID NO: 6658 - DNA, 166 bp, Bacillus thuringiensis
ctacagcgtgtagtatcagattcataaacgaaattgacatttatttttacatacgcggagcgttcgcttattacggatggctgacatcatcacatgactattgttctgcgccagcctaaataacacatgcatcactacattgtaccgcttggcacatatctaaaat

SEQ ID NO: 6659 - DNA, 278 bp, Bacillus thuringiensis
cacgtgtttcgtatcgaatccggaagtgggtgatctagcttactaacgtactctattcacaaggattaattgtcccacgctccgcaatgcactgaagggggggtttaatataaaatgggggtcgttcaccgcaccatgacctacctagatatgctaaatgcacgcgagagacttcctattaaatacgggctcatgtgcttaagaacgctttctagagtaatccaggggtatgaatgcacgcctacattaattaatccacacatgcttttagccttagt

SEQ ID NO: 6660 - DNA, 499 bp, Bacillus thuringiensis
catctttatagatagcatatgatattgctccatgattttgtatggggcgaatatgactatgatggaggggcgcttttatatcttcagaatctatcggcttctgcactgcatccaaggcatccagaatttctataactgctgcacacagatccgtgctactgagcaagtggttgacacttcaccactcatatcaagactaatacccgaatgcttgcaacggatattaatgcctctatcgttgaatacatatcttaatacatacgtctctatatagtagatccctatattccaaaggtagttccgcaaatcttacatcaagataaacctcggaaattatatagccctatgcaagctgaagaacatccactgggactatatacgcctgcttcagtacctttccaggggcagcttaatacacaggtctgagtggtgcccctcgtatccaagagctccattattatcagaatccctacagggttaggctgatgaaccgcaatat

SEQ ID NO: 6661 - DNA, 273 bp, Bacillus thuringiensis
aaggcggcatctacacgccatacccgataaaatttttttgtcatccctgggcgtgcaaatgctgacaatgcgttggctatcaccgccacagacaagcaacatgtttttctttctgaatgcacgcatgatgtcgcatccaaagcagacgagtacggctcccccagcattgacacctggcgcgcatgcataagacaatgcggatgacgactcgtaaccacgatccaacagagagaacagatcgactgttatgcgttcacagcgtggctaaagcaa

SEQ ID NO: 6662 - DNA, 276 bp, Bacillus thuringiensis
cacgctacacctatccatctgagacgctacaatgctttatttatcatgaggtgggacaggcctcacgaccggttggctatcgcctactcagagaggcctcggctaaggtcctgactaaccttgatcggactagccttgctgaggaaaccttaggcattctgcggacgggattgatacccgtctcgtgttactgatacgcgaagatgtcacttttaagcggtccaccagagcggacagactgactgctctgccctgagagcgctcctctatcactga

SEQ ID NO: 6663 - DNA, 121 bp, Bacillus thuringiensis
acagcctacaacgatccatcctagacgatagacacatttttttagcattaggcgggcaaatgcttacaattggttggctatccccgatacaggcaagcaccatctaattctttctcgaagc

SEQ ID NO: 6664 - DNA, 297 bp, Bacillus thuringiensis
agcgctacgacgagccacctgagacgacagaaacatttttttatcattaggtgggacaagcctcaggattatttggctcgcccttacttagagaagcactcggctattgatatagagaaccccgcttgactcgtgctagcaggggacacctggggatctgcggcctgactgacgctgcgtctagtcttacaatcgggtggtcgccaccttaaagcggtccaacagagagaacagaacgactttcatgcggtgtgagcgctcctctatcaaccattcgaacgaaattcattctaggct

SEQ ID NO: 6665 - DNA, 120 bp, Bacillus thuringiensis
cgtgatacttatataaaccaaaaatatagttgagccggacaaataataaggcaggagacttaaatggagacgaagcaggataatcaaaccaacgcacgctatgcaccccgcggaagaccc

SEQ ID NO: 6666 - DNA, 201 bp, Bacillus thuringiensis
tttttctcctagttgtttcagtccactctatggcggttttctttttttctccactctcaagcgtttctctcttgtttttcttttcttctcaatccctttctttgctctgtttccttttttggtttctcattctttttccttttctttctcccttttttctattttgttttctcatccctcctttttctttattcttctttc

SEQ ID NO: 6667 - DNA, 256 bp, Bacillus thuringiensis
aattactgaacatccaccgaggccaacggtagtgtcttttctagatgacctgacatacaccgcctacggacctttctgagttattcctgtgtccagcagcagatggcagtggccaaacgtctccgctcaccggattggactcaggactattgcgactggatgaggcgctgggatcaatctacgcgattgattagctcacacagctcttgttgtgtcaaaccccctacactgaggtgttattcctgcagcactatct

SEQ ID NO: 6668 - DNA, 151 bp, Bacillus thuringiensis
  unsure (1)...(151): unsure at all n locations
atcccaatttgnatactgaaattccttggtatgtagtagtcagaggtgctgtatattctttagttgatattacagcattattcccgagttattatgggacaaaaccaaaagtcgtacgtggaatattcacaggtggagccgctggaatagg

SEQ ID NO: 6669 - DNA, 140 bp, Bacillus thuringiensis
accccgcgggcgggatcattcttgatcaaccagcgcagacaacggcttttcttctatagctgtccccacccacaacaacgggggggctctttgaactaaacgtcggttcagcaacacattgccgtagggaaccgtttact

SEQ ID NO: 6670 - DNA, 472 bp, Bacillus thuringiensis
cccctcctcttcttcctccctcttctttccttccccctcccccctcctctcttttttccccccccctccctctctcccttcttccccccttttctccctctcctttccctctctcttccctcttctcttttccctttcctctccttcctctttccccctccctcctccttctttcctccctccccccccctccttcccttcccccttctctccttctctttctcttctctgtcccttctttccctttcccttctccttctctctctcccccctctcccctccctccctctcctctctccctttcttccccctttcttcctcttccctcgttcctcctctccctctccctcttccactcccctcgttccttcctctcctcttctctctttccccctctcctccctctcttctcccttttccctcccttcttcccctttcccttctccttttcctttctccccctctcctctcc

SEQ ID NO: 6671 - DNA, 364 bp, Bacillus thuringiensis
gaattggcttttttctgcggacgagccgcagtctggggcagtactttcacttgggacgaccaggggtgaacaatggataatgcatgataggcacttgtgtatggtacgaaacgagccaattatagcgagtggccagcgttgtgcatatgcgaaacctccggagaatcatccggcttttgtgcgcggatcattatgacaagacagaccggccaatgtgcgtcatgaactaacatggctcgttgaccatggcgtcgctcatagagatgataaaatacatcatgacgagtgcaggctcttatcagcatcatatatggaatgtacatgaatggatgtagagcagtatggactaacaatcggaaacaca

SEQ ID NO: 6672 - DNA, 296 bp, Bacillus thuringiensis
tgcgggacgttggagtgtagaggggataaccggcgggcttaagccttagcaccaacacgggagcttgtgtgtcaggctagagatgacatggctagatgaggttgaatcatacggattgatgctgatgcgcatgcccatctactgagcaattggaactaccgccgagggatattaaacattattggatgatacatagctagctggaaaggaggacatcatacacgaggcattctaatcacgatggattgctagtatgtcatggagagatgtgtaataattaaacccacgttttaaag

SEQ ID NO: 6673 - DNA, 129 bp, Bacillus thuringiensis
gactaaagtctgaccgagcagctgtttttgacagataactgggtgtcacaacatctacactttaatctggtaattcgcaaggacatggggatacattggtgacgaatacggaacaaccctggggggcat

SEQ ID NO: 6674 - DNA, 108 bp, Bacillus thuringiensis
cggtgcattgaaattcatagctatgagatcacttgtcagctttgatcgtcactcatgactgctcgaacaggtggatgtattgaaattgctagagagttactctagaac

SEQ ID NO: 6675 - DNA, 312 bp, Bacillus thuringiensis
ccggcttcaagcaagtgcctcttatagcggagaattggacccagatagggctgcgggagcatccacacggtaacaggagaacgctctcagggatcccggaccggaacgtcaaatggctagacaacaaccgtcgcgatgaagtgcccctacttaaaccattactctgatgatggttattggtctcatcgcaccgtaaagcgcttgatcagtaccatggagggagccccctgtctaaagcattgcgggagaagccggctatcttgacgacaaaagaagggctgtcaagcagagaggagcggtcactaggggcct

SEQ ID NO: 6676 - DNA, 330 bp, Bacillus thuringiensis
tacatgtcaccgtgaacgactacgggggtcattggtcgtcggaaggggacgaggttatatacattactgataacattgaaaagttgacaaaattcatgcgtgggatcttttaagatttctctcgactgtggcgcagtttgattgagacacaaaatggtttctaatcaaatgcgtgcaaccggtgacatggaatctgaacagaactatggacggtgaacacgttgctcaatggcaaagctttatggagaaatttgtttggggcgtttcgtactaatgcattcgcaattgtgactaagaattagggtattaatgatacggacatcgcccctt

SEQ ID NO: 6677 - DNA, 363 bp, Bacillus thuringiensis
ggcccgatcaaaggtgagcggcgacgacactacctatcctaacttcatcgaacagatctacacaaataagcgccttataaattggaagagcgcggcatgcaaccatatcacttgctgtggaaccaaatcaatcaacactaggcgctgtaagaaccattgcttcatgggtaccgatcgcaatgatggcatataattcagcactacactaatcgagtgactggaaaaaacacactcatatccaaataccgaacacatgatcatgaataatatgatctaaggcatttaataccggatggtactggaccattccaagggacgtcttagatgagctaatattgatacccaaggagagagtgagcaaac

SEQ ID NO: 6678 - DNA, 317 bp, Bacillus thuringiensis
aactattgcccttttttttctattgatgcggaaccgataagggggccgacatatccaaattctgcacctaacgtaaacaatgcataaacaaacggtacacctggttgtaaccgccatgcatatggtcttaagacacgagcagatacaatgaatgatttaaaaaaagagaataccttagaacctgcagctacagcaaaactagggttatacatggcggtactgttcagacaacttgctggacgagtacctaaatataaaacagttagatggaaatttgtgcagtcttgatgcatgttcgcgtgcatcatgacttgttt

SEQ ID NO: 6679 - DNA, 321 bp, Bacillus thuringiensis
attatcggcctgttgtttccgattaaagaggaaccgatacgggagggggaaattaaagtgacttctcgggaagtatatattgtctattcactctaagctcaagattgttacctggatgcggaaggtctactggagtcagaggatccagtgattgatttaaaaaaagagagaaactcatgctctgttgattcagcacaacttgttttatacatggtgatgctgataggacgactggctttactagtacttcagtatgcagaacgtatagggtaataattggagacttgatgcatgttcgcatgcgtcaagattggttatata

SEQ ID NO: 6680 - DNA, 326 bp, Bacillus thuringiensis
actggtaaaagagacactgggacatgcggctcatacactacgagacggatgaacataaagcagcacactacatgagcaactgaagatgaaataactagcgactttggagatagtagaaatgatgatgtttgtgccttactagctggaggagtaaccgctggaatggatgtaagcctttgttcacaatcaatctacagggatctgcacatgaggcaacagctatcactatattaccatctgcgcccggagagataatcagtttatgtgcatgaagacttacaggctgcggatgatggaacatacagatgtctgtgctgtaccagggg

SEQ ID NO: 6681 - DNA, 357 bp, Bacillus thuringiensis
gaactttatgagtatgtccgactgagacggaagtttaccaggactcgcccagattgcactctctaaacaagagaggacatatagtgagtacaatacttacaggaacagatacggggcctttcatatatataagctcacctaacggaacctgtttcattgctaaagcgcttgatattaatcttggaataccaatggacagtaactacacatgctataaattattggactgggatgaatatattgacagattgcacgtaggatatgctcagctttgtggacaaaacaacagtctagcacgaagtcttctattgaaagacgaacttggtataattactggacgcggtgctctatatgggt

SEQ ID NO: 6682 - DNA, 161 bp, Bacillus thuringiensis
acagggactatagtctcaccgagcatctgcctgtgacgtgatgacaggcttttacaccttaaacgtctgtgtagcggaacgaacacagggtagttggataacttaggaccttgacggtacctaaccacaaagacaggggttactactgagcacactagcct

SEQ ID NO: 6683 - DNA, 300 bp, Bacillus thuringiensis
catccgggaccatgacaccagaggcggcgttttttaacacaagtccacgataaaagaacgtggccttcaaaattagaggacggcatttctcaactcggggctaaagccacttaggcgagctatttccacagttgggaacctcaaaaccattgagctggtgtgaacctaaaacacaggctaagccattaacagaaccaccccttgttcgtagaactgcatttagtgcgaacaaactacctactacaccaaatccttgagtgggtaccctcttagcactaaaggacaccccaaagacgctac

SEQ ID NO: 6684 - DNA, 259 bp, Bacillus thuringiensis
cctgcggtgcgtgcgaacatctgatcggtagaattctctaatcaccgagcggagaacggcatgtctggcaggctatcacaaaaagataatgcggatgaagaagggcgctcaattttgtacggaacacatcggatatttatggtctcacagacgctggaagggaacttccatggtatatgcctcgtgagggatagaacctttaacttgagcgaaaataaaaacgcatatgtcaacagtttatgaagaaaggatgacagct

SEQ ID NO: 6685 - DNA, 395 bp, Bacillus thuringiensis
attcgtgatcatatgcatctagcgcacaatttgaacacctttctttatctcacgaacaaccacggtaataggggcttgaagaatcacactggcggctatgatggacaacaaacgctaatagaaagacttggacagaaacgacagggggtaaaggcagatcttgacatatggaacacggtatgacaaatcataattgaacagttcttgcgacctacacattgtaaaatcaacacttgattacattgctgatggtggtgtagttctaaaaggataagctgcggatcatgcctcgtcaccagtagatgggcatgcggtataccctggtgacgcatattgtgcgccacaattaagatcagagggtttggtggcatgttaccggacagagaagatacttc

SEQ ID NO: 6686 - DNA, 382 bp, Bacillus thuringiensis
cgtgattgattcactcccgactgtatttacaacagacaaatctattttatgtccgcctctaatttactttataccagcccagtcaggaaagtctagatcctaatgcttctgactcgagaagaaatcatccagcggctagtgtttgaatatagcgcacaatctatccacgtctaggtaatgctcgcaaatatggggagtgtcttgatccagacactgaatcaggtcaaacgggatgagagaaaataaagactggtaaaatggtatcctttagactatactcctgtaaatcttgttttaaccaacctgaccgcttatcactgataaatacttcatcccacatttatgaatcgtggtattacatatattactcagtgcctaataa

SEQ ID NO: 6687 - DNA, 144 bp, Bacillus thuringiensis
  unsure (1)...(144): unsure at all n locations
cgtgagtgataatacctatatactcaaacgacgccgcaaacgatgnttacattgccaaacagccgcgactctggggaaccaatgcaataacttcaactgtatgtaacaacacccacaccgagtacatacccatcaaattgttga

SEQ ID NO: 6688 - DNA, 177 bp, Bacillus thuringiensis
gtgatttacaattgcttactatactaccgacacatatttttttaactcctggatgaaccatgtaagaagggatggtatattctatatctgtttgagcttttaatactttacacggaatgctgtacgtaccatatgtaaaggtgctagagagtgggtggtgatctgggtcagtctata

SEQ ID NO: 6689 - DNA, 100 bp, Bacillus thuringiensis
agaagcagatgatatttatataggtgtttttttttcacatcaaaccgatggttccgcctaaccacaatatattgagcaagttgctttagatcttgctcct

SEQ ID NO: 6690 - DNA, 167 bp, Bacillus thuringiensis
acggagtcacgctaggagtactaagggagaaatttttcttgcaaatgtgcttgacgagctatgtgttcgctcatactatgtaagaagaaagcgaacgagagagggtgaacaacatgagaagtagtggccgatgatcggttgaagaactttgtaatatgaaatataaa

SEQ ID NO: 6691 - DNA, 231 bp, Bacillus thuringiensis
tccctgctcccaatacaactttgggatggtattgattttctacggggttgaaaaactaattatgattctttctgggaatatgatgctagcttaacagcagaaataccactatcaaaggcgaatgttgaaaaaatcaatttcatctgcaatggtttttaataggcctaccatgttatcgaattggttattacctatagccctaaattacactactacatttttatttttgta

SEQ ID NO: 6692 - DNA, 478 bp, Bacillus thuringiensis
attcgtgatcatattaagtgccgactttacttgcgcaactttatttgtatccccagcaactggaaacatggggggggggaattttaacaccggggtcataaatataaacaggacagcatctacaaggacgtacactaccgcaggaaaacccgcatagcgttcatatacacgcggaacaacaccctcgttatgcaaccctgtttctgttgcgggagatataaagactgaatcaaaacccttacgtacagccggatgaaaaccaagcgctatgttacgcacagaaactgtcgctaaacactctggatacgcagcataaacaacgggaatgcgcacgtacaatggctgctgcagtaacaacctgaataataccagcctggcccaaccggaaccacaagagcgacaggcttagtccccggcggacgatctccattcaaggaagtaagtaatacatacggaggttgtgaaaccacaatattcc

SEQ ID NO: 6693 - DNA, 430 bp, Bacillus thuringiensis
gtgattaattatgactgctaaggagcatcatagcattttttttataagcgcaacaacatatacggacgggggcggtaatgtgaattgaaatgtcgttccaaacgaaatagaaaacgactatacgtgggcataagtaaacgcgacctaaccaggaaggaccatcatgacaggcacaatgggacaggttactacagatggaggggatgataattgacgaggggctacacgcggggttttaaatgatgtgaataactaatatataaacgactctagcgaccggaccaccctttataaataatacataggtcgtggacctttagagaatgaagtagatctgacataatgaatgcaggggggaaggaatagttgaaggattttaaagttgccgaacaccacccagaatatattgaattgatagattatttgaaga

SEQ ID NO: 6694 - DNA, 106 bp, Bacillus thuringiensis
ggaacgatcagggggatcttaccaaagaaagaaggaacgctgtggtagagagagctggcaagttgaatcacttgcaaaacgcacccgctgtacattcatcaaaagg

SEQ ID NO: 6695 - DNA, 250 bp, Bacillus thuringiensis
cagcgatttcaaccccaattgggggcgttttaaacataagaacacgaccgactgctcgattatcttcttcgagactttcgaccatattaaagcgtggaggaagccacctcaggcttaataaaagaccattatttgtgccaaaatcccaactgctccccacgaaatcatatctagaagtgaaattgaattacttgctgtcgaatataaaacgattgctaacccaagtaatcgcccctccaagcaccatagc

SEQ ID NO: 6696 - DNA, 121 bp, Bacillus thuringiensis
aaggctacaactagccgccctacacgatatactttttttgtcaacaatgggcgggcgaatgctgacgatccattggctcccaccgccttagacaagcaacatgtatttcctcctggaggca

SEQ ID NO: 6697 - DNA, 123 bp, Bacillus thuringiensis
ggcgtttactggtgctgcatatattcctgcacattctaaaacggtgtcagagatggataccatatcgccagctctaatccagagtctaataataaaatatcccgcttaacatgaacactttta

SEQ ID NO: 6698 - DNA, 249 bp, Bacillus thuringiensis
cacccgcgttactttcagatgcttttatcaggactagcacgggggtccattgaaggaaagtgcggactaacccgcgtccgaagctgtttgcgcaaaggttttcaccgaaacctattatgctgataacgctaaaccgaaatcctacgcccatcagccagaacgacaccgctaaaatctccataccgacgaaattctggagatacaccattgcacttgttccactccaaaacaaaaccaaggattactgcg

SEQ ID NO: 6699 - DNA, 480 bp, Bacillus thuringiensis
tattgaacagtgattgcgtcacctacgaatgattttttgaccaagtaatatcgcatgtctaagtggggttcattctatgcacaagggggatatgactaagctcaatatttgtattgtgtcactcgttattgtgactaatactatgctgataggattaatgggtggaggtcacttgaatttgagactaaatattgtgggatcagcgatcatatatttacatgaatacaaaataacgacttagaaggatgcatagaatgtacctggatataaacaaggcaccatatttggtgctgaacatagaaaaccacactggatgagtgatatatgcaaggttatgctagggcatgacaggtcactccccaaagcttctttacgacagcactataatctgaaaacaggggaaagaattactgatgacgctgtaggaaggattatcactatcaacaaggatcacgaagcagtatatgatccttatatggg

SEQ ID NO: 6700 - DNA, 122 bp, Bacillus thuringiensis
ccagcgctaactgaacgagagtccttatcgcaacatctaatttttgtatccttcgaggacagtcagcacatcctggaacgatgccatcatgccaagacatttcggtctagattgccttatta

SEQ ID NO: 6701 - DNA, 154 bp, Bacillus thuringiensis
gcgctatttccagcaagaagagaccgatatggcggaggttatttatactctatgcaaaccgaaagccctcttctaagacggcttctccaacgtcatatgcccataatgcgtctatcaaggcggggggccccttcgcgtgtcatcactctaaaca

SEQ ID NO: 6702 - DNA, 436 bp, Bacillus thuringiensis
ccccgagggcgtgataataggattcgaccttccaatatgggggcccttttttaattgacttgtcgtctcacccaagccggggccgagtcaatcaccttgcgggcgatgactcattaaatttggtgcatctgttttatctacagaacgaacatcaacatctataggattagggataatgaacgctgatattatgtctcacattctcattaagtcacgttcaacgctatatccatgaaaaccggctccttgtacatgaactgtaacgatgcctgcattgagagccttatctaataaccggtctacaggatgccttgaaatgtgagtattcgaaacaggatactgatgagtacaattgatctatataatagtaccaagctacacaaatgactaaatcttcttcatagatcacttgagacatactactcatactttataa

SEQ ID NO: 6703 - DNA, 124 bp, Bacillus thuringiensis
acgcgttttctacagctcccctgggctctagaaactcttctactcattcacataagaaccccgcaatattcatccgaatatcaaatgatttatttgggcccttttaccccccccgggggttttc

SEQ ID NO: 6704 - DNA, 213 bp, Bacillus thuringiensis
tgatggagccggtcgaccaatatagatcacagggaaggttgccgcatctacggaagtaacacgagaagggggacctataaatacagtgtggggtttgacagtaacgctgaagtgcacgaaatgcgctacgacgagatgccatcattgcaggagaaatggacacgggacctggcaaaccaccagaaggagggacccgtcctgaaagggaagggg

SEQ ID NO: 6705 - DNA, 252 bp, Bacillus thuringiensis
caaaaggcgttgttatcacgctgaaggaagccgctctacacagggggcccttcttaactgcctggggtacctacaatatctagctagaaagatcgacatgcaacctagcgcatggcctcaactaaacgctacaactccaggacccgcaatgccagattatgacccacgaggaaacccacgtgcagcaagtctatatagggccatctacagaccactggccgtgaaatacccgtatgtacttagggttctcct

SEQ ID NO: 6706 - DNA, 274 bp, Bacillus thuringiensis
cgtgatgaacaatgcaaatccatacacatcacacacatcttctccagcagaaacgacgaattatctatgggggcatctttaattcacaggggggtttacaactatatcagcgtaacatgctatttgagcacaaactcctacagcaccccataagacacctacacctcacctggcaaatcttaagaatgaaactacctgaatcaaaggacctgctgaatcgaccgaaactaaatctacactataacattcaacaactatcgttactccaaaaaca

SEQ ID NO: 6707 - DNA, 296 bp, Bacillus thuringiensis
catcagaaggtatcgaaccacaccgaggcaaagtgggtgtggcgtgaaaatagattctacaggggcgacgagcactacagagactatcgcataagtcataggtctcgacaccgttgcgaaccataaagagtcattggtgctgcaccggagagctctcatgtgtacgaaatcggtactcataaacctaatgagactgacttgtataagaagtaatatgatgaacacaccttgctatctgataaaatactgtatagattctatcctctttctgctgtccacctctttatgaccctatc

SEQ ID NO: 6708 - DNA, 160 bp, Bacillus thuringiensis
cagagtggctgcgagacatctcaaaacccatgctctctccctgtttttggcgtagattgaaggatggcatccagtctatttttaacatcatgtacttcttgctcccctgagtatggaacttgatcaaccgtatatttctctacaggcttgaatcttaccg

SEQ ID NO: 6709 - DNA, 279 bp, Bacillus thuringiensis
ctaacgaccatagcctactccgatgactccgctgtcgtctattttgacatgtacaggctcatatggcctgggggtaatactcgcaacggctggtacccatgaacaggtggttgcctggctccgagaggctccagtgcaccgatattcagcgtcgtaagattatggcataatagacctatcgtctttgctaccgccgtatggctccgactctaacacacctaatttcactagactattccaatattctctacctcattgcgcttaacacaaatatactat

SEQ ID NO: 6710 - DNA, 335 bp, Bacillus thuringiensis
taatgagaggttttgtgcttatattaagcgcgaatgaggttgggggacggttggattgactattggaacacttattattactggctactgtgacacttatgcgcaatacgctcttgcataccaacaaatacgcctccactgcgttggcacacttagtgtgccaacgcatgaggtgtctggtcatcttccatctggtgagattacctgatcaggttagtggttggtactatactatctaacactacacactctctggggcatccctgttcgaactgttgtatacagggttagcgtcattaggtggatggcatacacacccacctgatccggctgtc

SEQ ID NO: 6711 - DNA, 224 bp, Bacillus thuringiensis
attacagccgagcctgataatacgcacgctgtaaaggatgcattcaatgcgagtgcaattatacaacagacggcttcttatcttcaccactctttacgcggttcacgactacctttagacgtaagccaatgcgaaaaaaaaaaagcgcgcataactacttttgggcttgtaatgatatatgttttctatggaacggcccttgccatcgtttatatgcagaaaaa

SEQ ID NO: 6712 - DNA, 315 bp, Bacillus thuringiensis
ccagcgcgaacgcaacgcccaaccttttcgcaacagcaaatttttgtatcagtcggggacagaccacgctccaaggagtgatgcgcatgtgcgactaaaatagcatctatatcagtaattattatgacatacacacaaacatacttcctacacggtgagagaggacaacgcgtaatatgagccaaatctatcactcacttgaacactgactctagacggagtatgggatcattaatgtgccagtcgagcatatggtacaacattggctaagttaccgctaatccaatgaaagcaatggtaatccaagacgccgtt

SEQ ID NO: 6713 - DNA, 362 bp, Bacillus thuringiensis
ataggcgtcagttaccctagcgacagagcagctgctgtggcaacttttttcgggactacaagaagagacggcataattgcgaactccaaacgtggatttatagttccatagtttgtatcgacgtgagctgtatcaaggttcgtgaagcagagcgaatgccaaacgacccattcagatgcagcaggtaaaataggagtattctcaatagatatatgtaactatcattccgggacagcttccagcatatttgtatacagatcttcagagtatccagcacgatgccaaccgtagatacgccgctatggtagataaaataacctttaagcgtgcattccaaacgcagttattaaatcccgtttgaa

SEQ ID NO: 6714 - DNA, 211 bp, Bacillus thuringiensis
gagcattagtgcaccatttgttatataggctagatacatatctgatttcttaccaaaataatatgcatataacgtacctaaaaaaagctatgaacattcgaaatatctagcacttgctttataaagcgcgcgacagtgaagctaaaacgttcctttagtatatttgactatcataaaatttgcaatacaattaaagccttctctccaccct

SEQ ID NO: 6715 - DNA, 550 bp, Bacillus thuringiensis
cgagcgctaacgcaacgccacgaccttttcacaacaacaaatttttgtataagtcggggacagaccacgctcacaggagcgatgtgtttatgctaataaaattcatcaacacatagtgctttgtcatacactacaaacatacgttcctactacggtgagagaggacaacgcgtaatatgagccacaattttcactcatctgaacacagaccatagacgaagtaatgggatatcgaatatgccagcagcgcatatggtacaactctggctacgcttccgctattccgacacaagcaatggtaatccaagccgccgttgtatgcaattcatgaggccatgctcatgacggacataccacctagttttaaactagatttgcaacacgtattgacacatccaccatcaatatagagccgattgaaatgcctattggataacgcaattccttcattatttgcgctcgtaacataagctatatccgcctcattcaagaactttgttttaccaagtccatttcgggttatcgaaatactgtttaaactattcacatg

SEQ ID NO: 6716 - DNA, 399 bp, Bacillus thuringiensis
ctgaacatcaaatattgtggtctgacactgaaagttacttgttttcgctactggcctagtcggacgaatagagggatttggtctaatctgaaaacgtggtagacatgaaaccacttattaaaacgcgcacaataaggtggaggaatgaatcatgtataacacatttcttctttgattcagaatggaactttaactgattccgacagacgggattggaaacccgtgttttacatgcatcaaagaaagttggaatttgagaagtacatataagtgagatagattcattcattaagggcctactattcagcagtcatacatagagagatataattcgagcgaaggatagggcgaacgtgctgcatcttacttccgggagaatattaaagcagcgtggatagc

SEQ ID NO: 6717 - DNA, 353 bp, Bacillus thuringiensis
caggaggaattttttatgctttgacacctgctcataacaggggagcattaacaaaagatgggaatggctatcaagcctatgcataacccatactcactacaattgatcaaggcgaagctacctcactacaaactacagacctagacagaaaaaatcattcttgttccggtcgacatgaccagccaattacttctgcaaatagagaggataacaaatgccatgcaccatgacgtcaaacacgtcaacggaacttccgaagaaacatctagtagatcagataacagacagcatgctgatctacacacagatacgcaccttccaactacaggtcatatagacgaccctacacacac

SEQ ID NO: 6718 - DNA, 256 bp, Bacillus thuringiensis
atggattgtccacttaagaataatgggggcacgtttatgaacatttgggagaacgatagcctgaactattgccagctatgatacaaagtgcacagtcaatgacagactccatgcttatatatgcatatgtttatttagacaaggaccgtgcatcacaaacggcgggaacacaggatgaaagaaccagtaggagaagcatcggaccaacttttgacagttgatgaagttgacataacatgaagttatgataactaaa

SEQ ID NO: 6719 - DNA, 255 bp, Bacillus thuringiensis
aagatgttggctaacccaggcaagccctccaacgggggccttatagaaagaggagccggcaatcctcatggtcgcggtacaccacaaaagttgaaagcgtccctgggagacaccaagactagctgagtctccacaattgatgctcccgaacatgtagaaacgtcccatgcgaatatgagagaaagaagaaccagacccgaacacacacaacccgtgcaggactgcctaagctcacgcgaggcccacgtgcttgaa

SEQ ID NO: 6720 - DNA, 315 bp, Bacillus thuringiensis
agctagcaaccacgggggcgggaagcgcgtcaccgaacggagccagaaaccgcgattttttaacccgctcacccgggtccaagaacggggggcaatggaaaaagagcaagggtactaaaaccagacgcaacaggcagagagaggggacaagcgcagagggccctcccccaaaaggaaaaacacagcccgagaaacccgcaccagacaggccggcgcgagcggcacaagcacacgcacaggcggcagaacggcaaaccacacaaacaagcgacacaagtcgaacgagtacgggagcaaaaagggcagcaaaaggcc

SEQ ID NO: 6721 - DNA, 127 bp, Bacillus thuringiensis
tcaacctgaactcttaatctcagcacacatcccctctcgcagcaagcgaactagccccacccgccaatcctacaactagagctattagagaccgactcccatttcctattcaactaaaggctatcat

SEQ ID NO: 6722 - DNA, 333 bp, Bacillus thuringiensis
aatcgcgaaattataacccgctaacctgagtataagagctgtctgctatggtgcatgagccagcatcctataactagactttagagccatctagaatgaccttgtcattctggtaataacgaaaagtggacagtgcttcatgagattcctgcatgagatacatggactcgttggatataaactccgcatctaatgtagaatgtgctaacttatgagctgacgtctgcagctgaatgagatggactcgaaaggcggatctaaagagccagtggagcgggcactttatggcggagatacatagtcgactgttccagatgtctcattgttattgga

SEQ ID NO: 6723 - DNA, 215 bp, Bacillus thuringiensis
tcagcaaacgcaatgacggatgtggcggagtatttttttccaacggtgatttatgaagatatgggggggtttagtataacgcaattgacgctcgctgttcagcgatcgttatctatattcaaattgctcgataatcacgtgcataatattacaatctctaatgcacaagatcgtgttctacaggcgtgaaattatataatgcaggattatttggg

SEQ ID NO: 6724 - DNA, 124 bp, Bacillus thuringiensis
accccggcattcataggcaatacccaaaccacatgactggtcttacctgcgcaagcaatcgcttccactgcgaaagctatatgcgccacaaacgcgcaaaatggcattccttcttacagcaacc

SEQ ID NO: 6725 - DNA, 116 bp, Bacillus thuringiensis
cctcagcatcatgaatatgattcataatagtagcatctaatttttgtaacatttgatgtgcgttagcaccttctggttgtatgtcattattacaagactttactttatcgatagcc

SEQ ID NO: 6726 - DNA, 316 bp, Bacillus thuringiensis
ttgcttgcacgttaagatacatcagtgccttgctttgtttgccaaacacgcgacgccgatagcaatcaagtggactgctcacaccgatttggacgaacaaaaggggttactttctctttgcgaacatcagctgttacacaatcaatcatgcacggttcactctacacaacatatcccggatctaccgctaaagatgccatatgaagagccatcatttatttcggcctgagaggaaatttaaggtgatatggagccccaatttcggagatgccatgaccgactgggatgtctgcagtcgtgaattcacttcttgaac

SEQ ID NO: 6727 - DNA, 117 bp, Bacillus thuringiensis
aaagagacagtgatgctacatatatgcagtgcgagcgtattctttataatacataataaagctgtcatgggagataatggaagaatcagtgtcataaataacttcatcgatacccct

SEQ ID NO: 6728 - DNA, 466 bp, Bacillus thuringiensis
gcatacacaattcgtttttttagttgcgctcattccgctctatacggggggtgtagtgtggtattccccgtgccaaaaaaagctcatacaaccacatcatagtctgtatcgagaaggagatcccactgcaagttgagtccatatttcagcatcattttcagatgcaaacgtagctactgacgcacctgctcgtgtaaacggtgaatgaactgtatcaacggacttatctgtggctgccggacatatctcgactactgcttgcgtctagaaacccactatctttggagctgcgatttcaaggcacaggttccccaagctcatatctctgtttcagtaaagacacttgtgcagtttatactactatcgttgacacacttattgacgatgccaatgatgcgccatgatccctagtagcactcctaagccacatgacggacagtgcacattgtgaactggtacacgacac

SEQ ID NO: 6729 - DNA, 172 bp, Bacillus thuringiensis
cttcagcgcgatgaatttgaatcataatcgaagtctctaatttttgtaacattcgcggagcgttcgcagattctcgaaagatgacatcatcacaagactattggatttcgccagcctaaataacattggcagcaccacattggtaccgctggaaacacacctaaaacagttt

SEQ ID NO: 6730 - DNA, 339 bp, Bacillus thuringiensis
cgttaagaactaggacggaaattagcatggctcttgatacatccagtcaataagggatagttttacaagttggcgctgcctactacacacacagtgtctagagacgagtacaaagtagtcgcaaaggagacttgcaggtttcatactccaacacacagagagatgaatactgcttatttacctgaggcagtagggctgatacactggttcttgagcaaatatgcaaatgaatgcgctatttctacttgaggaccctcatggggatgttaatataccagcatggtctttaaaaacgtgagaccaactctagcggctatatatcgaccaccggttggctca

SEQ ID NO: 6731 - DNA, 225 bp, Bacillus thuringiensis
caaatgctggtttattgatgcgggtgacaaggcacacctcaatgggcatgctcagatgttaacagcggataacaattagactagtcatcaatgtaatctagttgatatagatccaaagcaaggacacgacgaattcccggtcgaaattatgcaaacacctatgcctgatgcacagaagacaatcgtgcaacttaaccatccattgctgactacaaaggcaatgaa

SEQ ID NO: 6732 - DNA, 347 bp, Bacillus thuringiensis
cgtggtttgcaatcatatcacagcacgatcaagttttattgacgaaactgcactggatgttaacggggatacattgacgttaccggggatagtaatcgcatccaacctcatctactagttggatatagattgaactaattgagtgacgcccggatacggggttagtaaagtggtgtctcgagctatttctcggacaaagaaaagttacccttactgaatgcaaacgggaaatggcacgtgggcatatctagtaactgcacgcgttacacctctaaaatgaccttggcatgtgcaatctctattcgggtagccgcagctattatttggacgggggttttcacaacttt

SEQ ID NO: 6733 - DNA, 318 bp, Bacillus thuringiensis
gagaaaggaacttactaccccgaccccagcctgctcacggggggggattataaaccctaaggggctttgaaaaaccactacaccaccacatctcaaatccacctcacctgggctctctcggtctcactaccaccaaaagcccacccaaaacgccaatctggatatatctctcaacacattcaaccaacaaccctcccaagagacaatgaccctaaagcaagcggcgcgcacccttcaaaaggaagaggatgaccattcaccacttccgataaccccatacccccttcacagcaggctctagcccaactgacctatcct

SEQ ID NO: 6734 - DNA, 320 bp, Bacillus thuringiensis
cataatctgtgatttttttctgtaatcaaggcgaacggtaccgagggggacttatctaacatgatggcctttccatagcactcggaaaattggatacaacctgatagtgcatgagatttaagcattagatgcaacatgcagttctttacgatatgttcaggcattcgcgtgtggctggggaaagaccattcttgcttactgatccgtgcaggatcactgatactgtgtcctaatcgttaagcagaggttcgcgagctcgcagattttattcccatatagtgagacgtcctatatctagacgtgaccgataccgctgcaga

SEQ ID NO: 6735 - DNA, 276 bp, Bacillus thuringiensis
cgaaatctagcattttgtcagtgacgccctctttgtgactagtgctgtgatcgccgtcgcttctaatgagattggtatcaatgccttttgccgataaccatttcaccatggtgtgggtactcctagctcccttcgaaacatcggtctgtcgttatggcgaggtataggtaacagctgcgctgatgttccctttgtgagctactgcaagggttgctatctccagatccttgaggtgagaacccgttgctttgacacactcggcgtaggtctcattga

SEQ ID NO: 6736 - DNA, 370 bp, Bacillus thuringiensis
aaaattcgctattttgcgtaaccattcgggttactttaagaggggcactaccaaatgctcttgtgggctattgactctcggccatacctatgatcgctgagattggttgcaccactaccgtgctgcatcgacatgcggctctagcgctagcgaccgtctctcccagtacgacgtgtttacagcgccgttactcgccaaaatgaacaatataatacaggcattgaatccgctcggaaccacgactgctgcacttggtttcaagcggctgatcaatccgatcacgtacttgatgatgaacaaatcacggagatccacctttcctgtgcaggacagttatcagaccctccagtggcagaacatccttgtcccc

SEQ ID NO: 6737 - DNA, 254 bp, Bacillus thuringiensis
cagggcgtgatcgcgcatacgcaagcatcgtagtgactaagaatttttttccaacggtggggactgtaaggaagggggggcctaatatacaatgccggaggctcgacgcatcatgaccaatctagaatggcgtaatacacgagatcgacttccatttatatggtgacgcatgtgttctagcacgcgttctagactcatgaaactatataatgtacgcttactttaggtacgacagacgtggctatcgccatggt

SEQ ID NO: 6738 - DNA, 299 bp, Bacillus thuringiensis
ctcgtcgcctaatgcagccagaattcgcgctttttctgaacaggccatctcacaccaaaagggggacgtttacatattctcgagcgaaaatgaccctgcacctcttccaggtatcatacaagttgtcgcgccaatgccaggctccatggacttcctggccgagatataaccaccctctcaccctgtaacacagaatacaggaccgtcactacaccaactactagaacatgcataggatctctttgttcagccaatcgaagatgatgaacgtggtcataaggagaacttcagacacagat

SEQ ID NO: 6739 - DNA, 252 bp, Bacillus thuringiensis
cgatcataagaacctaccgcaatgcaacaaaaagttttgtcgcctcaaagggcaccgaagatacggggggatgaatgaaccttggcgggctgctacatccatcatgaccgaactccaaggttaaatggactgggatgaaccccacatgcctcgggccacatgaagtaaaacaaccccgcttgagagttcacatggtcaacgatgagctacctttagtaaacacagaccaaaagatgtacatggaggtcagga

SEQ ID NO: 6740 - DNA, 441 bp, Bacillus thuringiensis
cacaataggcgacttttttcgatcggtcatgtccaagtagctggggggggtttatgtattgtcaggacatcgggcggcggtacgcctacaagttctgcttctgcgacgatcgagatggacacaaaccctgctgactgctaaatatgctcaatcacacctgcaccggacatgatgagagggagcagatttgcatctgatcattataggcgaggggtagcacgactttggactgtatcattcagatgaggtaacagttcaaaatgaaagcttaaatactggatcgcatcgccttgagcatagcggatcgcttcctgcatagatgattgcccaaaaaaagtacggttctgcatgccatcatttatggcgtgagagatgtagttagttcatggcggacgtgcctttagaagaagcgaactcttcgtttaagacggtttggattga

SEQ ID NO: 6741 - DNA, 132 bp, Bacillus thuringiensis
gttggtttgagacatgagtcgttgagcatgcttttttatacgatatacttcctgtggccacgggtacatatgctcctatggacactagtcttcttccagtttctgtcctcatttctttttcgactgaccatt

SEQ ID NO: 6742 - DNA, 399 bp, Bacillus thuringiensis
ccgggctggttttttgcatgcttcagctgggaagttggcccagtctgaaaaagtataaatggtatgtgtagcacccccaactgaaggtttgagagaccttgcggcacccgttgttattgtagaaacgctttccgaagtattggcttcatgagcacaaaagaatggggctggggtacctacacgcggaccagaattttccgtactgacaggactacctgctgagttttacccataagggatttacgcattgagcctcagatcacagagcagcttcatattataccaatgcacgcttttctatactcgctggacaattggagcgatcatcagactggcccctaccaaaccttgacggatcatggggagaccgtgctgtacattccaagccggggggcgcca

SEQ ID NO: 6743 - DNA, 407 bp, Bacillus thuringiensis
aaaagagtgcttttttaaatatttcaccacaaacacaaaaaagagacgcgcgcccctagcgcgcgcttttttacacttatatatctctctttaaaagcgacactctttttaaatatatccccaagagagagtgtatccatatcacccccatcccatatttttatgtgtatgagcactgcgcggagatcaagtgtaaaaccgtgttggtccgccaccacaattggccccacttttgcaatttggaccgataagaaaaaccctggcacttttttttttttggtggaatacccttggaaatttggggatgccccgggactaaacgggcctggcggactatggttaaaaagaaccaaccggttggtcttttttactaagacttcaagcctttcaaatggttcaaggtttgg

SEQ ID NO: 6744 - DNA, 120 bp, Bacillus thuringiensis
gtgatctctgggtttaaagcttgtagttcaggcacacccatgatgtcgcctttacggaactagtacgtacggcggagttaaaaaagtcgtcgccgtattcagggcgccggatgcatccta

SEQ ID NO: 6745 - DNA, 334 bp, Bacillus thuringiensis
gtgatgaagcacgaataccagcttgcggacaactcgtgtctttaatagcaactcgatcacccttttgcgggcggggctttagaaaataaccggcaaacctcttggggtcatcatggcagatcgccaaagtaataccctgccctaacgagtggaatcgcttctttttctgtgtagcgagacgccattggccctacacgtatatgaagcggctgattttcataagaaatgggactcggaatttcatctgagatcacctgtacgaccatgggtgtttccacactgcatttcccgccttctagactagcatcatagtgttaatactggagctcgcctc

SEQ ID NO: 6746 - DNA, 698 bp, Bacillus thuringiensis
cggaatttccgggtcgacccacgcgtgcgatttgaacaaaattactcatatgtttttgtatgatttattgcaactaattcttagttatatgcagcatcacacatatcaacaagtttttgtgtcctgaccaggaacaatagatatcataccaaggagaaaaagtatgggctaacaacttgaatcgttaagcagaggactaggaatgaagattccaatccaaattactgaagggagcaagaggccagagccacccattcaagctgctaagtttgcatcagaggggggaatcacattgaggcagcacattccaatatttcaccactggaaggagtacaagaagaaagagaatgaacctacaataagaaactatattggaaaagatattgtaaggctcaattcaccttggacaatgatagcaaggcagtggaagatgcatgtctagatatgctaaagggtggacaatgccaaatgaggtatagactaaaacaaaagtatttcaatgggatacctgctaatcaagtgaggactacatcacctatttcagcatgtctgatgaggactggagaaggttggtggagaaagtggtctacccaaaacacaggatagttgtatgaagaataaacttaatcgtgaaaaagtacagtattaaacatgcatagggatcccatcatatattgcaaagcttattactgaaagag

SEQ ID NO: 6747 - DNA, 181 bp, Bacillus thuringiensis
tgttttgttactgacctatgttttgagcacggaaacacatattaaagtgtggggttttgtgtagagaataaacggatacacccgaagggtcgtacatgttgaatgtggaaactataattgatgcaacggctaagtgatagactgtttttggagatattacatcaagaaaagactttggggt

SEQ ID NO: 6748 - DNA, 414 bp, Bacillus thuringiensis
gtctgaggataaatgctttaggtcaaggacaacgttgtttccgtctttaccgatcaatacctcgtcgaagaaaattccgccaccgccgtattcagggcgatggatgcatactatatccaagcggatgctcgagaagatgacggtccatgcatagtgcgaggcttgcgcaggagtgaagtggaagctgtcatcgattctgtcatcgaatagcacgtcttccatagtgtgtaagatgcacgggttaacgcctattgctaactaaccaccgtagagcgcgccattgactgtttaggacatactggtcatgcgctctgagtcggaagcagctgctttatcgatacgaccgatgtcgagcttaagttgctcattttcgaaagtataaccggcgtaaggtgaacgagtgatgaaagaaac

SEQ ID NO: 6749 - DNA, 434 bp, Bacillus thuringiensis
gaagcttgatcctctgagcggccgccctttttttttttttttttacgattttccatctttattttttacgtaaacatccttttcatacatcaggccgatcggatccataccaaatacacacagacagtacatttcacacttcagcagacagtacacgtacacagcgctgtcgtttcgtacacgcttaactgctcaagatcaaccggccgggtagctagaccaggcacgcggccgtacgtgctttcgtctatagctaaacgcctaaaccaggcaccgtcgtccttagttccttacacacaccacgatcgggaagcacgccggcgagggagagcagagcagagtatagaaaaccataccggccggttcactcactccactccaggtccctggcagcccgggagcggggtccctttgcggactggtttggcgcgtac

SEQ ID NO: 6750 - DNA, 325 bp, Bacillus thuringiensis
aattagatgtggacgcctgttagcctatagagcgacctaaccaacattgggggcgttgcgcatactgcccgcttttcaaacggaaaacctgctggacaagccgcattaatggattgtccaagggcccgtggagagtcctgccgtgcattgggcgctgttccgctctctcggtcactgacgcgctacactgggtcgttctgctgcaggaagcgacacaagattactcagtggcgggaatacggaaatccccggaaccagggtatatcgcatgaaagaccatgggagcaaaaggtcagcacagggcctagaaccgcataaaggccta

SEQ ID NO: 6751 - DNA, 107 bp, Bacillus thuringiensis
tggtaccatagtttttcttcaaggtctcgctatttcacacggtagagtgcaacgcctaactgcatcactataatctgatcatccgttggtcgttattcatttaaaac

SEQ ID NO: 6752 - DNA, 134 bp, Bacillus thuringiensis
ggggactataaaaccaccggcgagaatatataaacgaactgcagaaaggagagaaagagcaccagaaaggagaaaagcaaaagtaccatgaaacatatcaacagttgcagaagtagccactacacaaacagcaa

SEQ ID NO: 6753 - DNA, 314 bp, Bacillus thuringiensis
atcattcgcgatttttttagtagcatctttaatatccgtaggggggtgatccatattgagctatccttctaaatgacgaatttatttgggctgtggacatttgccagtcgtgtgaccactcagcacacttcctgcattcagactcacagttcgctaatttctcatcacatttagagcaatcatctaagatctcagagatcacttgttaccatccttacgtaagttccttaatgacaggagaaaaggctaaagaggcggtacatcgagctcatgtcgaatttggttggactgcacaagcggcgcatcacgcgtga

SEQ ID NO: 6754 - DNA, 124 bp, Bacillus thuringiensis
aatcggatgttaccttgaggccagtgtaccatagcttcattagccccgattacctcaggcgccgggggaccttgaggccagtggcaccgatagcaccagaagaggccgtgttaactagaggccc

SEQ ID NO: 6755 - DNA, 328 bp, Bacillus thuringiensis
attcgtgatgcatacctacaagagcaccgtgtgaaaaagttattttcccaccgcgagagagctgctctgggacgggctttaagcgtacgttatcatgcccaaggccgtcgagctgtaatggtgcgtgagcgtctaatagacgacgttcagcagcactttttaagcgcccacttgaacgacccaccacaagatgctataaatatagaggctctggcggaacttgatacacgatcacgagccattgacgttcaagcaactatttgatgatcacgtgataggacaaggggcggatacagtagatcaatcaccaaactatatagtaaacagc

SEQ ID NO: 6756 - DNA, 434 bp, Bacillus thuringiensis
gaattcgtgatgtagcccttggtgactgccgtgtgaaaaagatttctacgagagcgagaatgctggtctgagaggggccataagcgtacgctccaatgccctactgcaaacgaactgaaatacatgactgaggcgtctattacaccacgatgaaaagctcttttgaagctcccacttgttcaacccatctcatgttcctctagctattgaggctgtagctgcgactgattcacgaacaagcgctgtaaacttaaagcaactatatgttgctgacatgcttgaatgaggtggccgccagacgagatgactcgccaaccgagataggaaacagcttccgtctgtaagggcatctagtaactgttcaagagttgttagaacgacatgatggtttgcgggagcttgatcgcgttcctagcacgttgatggctcgacct

SEQ ID NO: 6757 - DNA, 220 bp, Bacillus thuringiensis
ctcggaagcttgtgacaattattatattcgcaccgctattcactaactcttcaatggcatatcgcggttttagaaaacttttcgctgaatccccacacccattcgcctactttaaaatatttttcgaatagctatatcggctgggacggctccactcgtcataccttcgtacttcagccacctattttgtttctctctagaccctcttgactctgataaa

SEQ ID NO: 6758 - DNA, 119 bp, Bacillus thuringiensis
cgcgatttatatgcgattggtgttgtaaaatcaacgaatttcatgtaatgcgaaagtcgctgaacaagggggggtttataaatgtgttttgacaacccacaacactatgaaaaagactt

SEQ ID NO: 6759 - DNA, 239 bp, Bacillus thuringiensis
gagctcgcctcggctctcgaggcgcgtgtccacatttacataaaggccatgattttcatgtaattgcataaactccgcccgaatgtgtagcgtgaaactaaacggccctaaattcaaaggcgtttatatcaaggccgcctatcatgaaacgagttggcgaccaatgcccgctctgtgaaggatttttttgaagcaaccctggggtttgccggatcgggggccgtcttaatcgattaccc

SEQ ID NO: 6760 - DNA, 459 bp, Bacillus thuringiensis
ttcgccatcaaataacagacaaaggtgccgtatacgacataataggtttcgattctaagcatgatggagaaatagactcgcgactatgtcgtctgggtgcttagcccgtagatctgaattcgatggaggtattgagcctcgagtttgattagaatgtcactcatgaacctccttctctgcatacttgtatgcatggatttcatagcgcactacatggccttgatcacactgaggatgaacgcacgttttatcttacccatcttgagacggaatccgctgggttattttagctcagcccgcaccatctattgctctgtttggtatgtcccgaagaggacacacttacctgtgagagctcatgaatagatcacactttcaagccttacgtgtacaaaagcgttccactctgccctgttagagatagtgagttaggcctactctgagaataagtacatgatg

SEQ ID NO: 6761 - DNA, 210 bp, Bacillus thuringiensis
cacagaccaaaatgtctacccatatggcgtacaccattctattttcttgccgaagctggatctcgccctggatattgacagcaactacttgctgcagaataatacttaacaaaaacggtccattgcagcgctccactgcggaaggtgatcacgattactggcaatatggatgcgcagattcgaggaagatttacccgattgactatacga

SEQ ID NO: 6762 - DNA, 306 bp, Bacillus thuringiensis
gctgggaggttggtcgacgaattatgatacatcaggggatttgactgttttcactagattgggaactggaatgagacggaccccccaggtaaaaatagattttacaaatgtggccccttatttgtgtttttagccataaatggccagaatcctttatttttttggggcatttggattttcaaggaaataatatttttttaaaacctctatatccttctataaggaaaatatggttaataatatataggtggtatttttattgcttataaaaggggggaaggggaagatggaaatggaagggtaatc

SEQ ID NO: 6763 - DNA, 237 bp, Bacillus thuringiensis
cgatccaccagctagtaaacgatttgcaaacggatttcctgacacgcattccagttatgcaaactgtgggtgattacaatggcttccatggaactgccacgagaataaataatttagtttgggtatatggaggcaactatgctatagaaagagggattagatctagaattgttgtaacatggagcaacggaagaacaaggacgtattctacgacgacaaatacgaacaagtagagac

SEQ ID NO: 6764 - DNA, 293 bp, Bacillus thuringiensis
ggagaataaaagcaggcagaaaacactttattataaagcacgcggaagaacggacactgggggggacagagagagagacagacgggggctaaagaaaaaaggaactatagcgaaaggagaagacacaacggaagagcgacaggtgcaagatggatctacacgaacactaaaaaggaccgaaaaaaatgaaaggggggaaaaccaaacaaagctataaaggaggcagggtgaaagaacagacgagaaaagggagcgaaccaaagaacgaagagaacgggcaaaaaaaagaggga

SEQ ID NO: 6765 - DNA, 115 bp, Bacillus thuringiensis
ccaacgcatagtctttattacagcaaaccacacaatcgcgggataaggctagactgaacatgcgagtttgcggcctccaaaagaccaggtaccgtatgcaggctgcgttgatgcc

SEQ ID NO: 6766 - DNA, 302 bp, Bacillus thuringiensis
atgaccaccacgaatcatatatgcctgtcactgctttttatatatttccaccgcaccaggaattttatgaccaggacgattgctcagctggggacaagcaaaaatcctaatccgtatgtgattaccctccaattgaactcgtggtgatcttgaattgggaatatatgatcactacacatccagatgtgagcaatacgttatgctattaatgaactgtaccaactgatgaactccaatgaccactgacacatggttgcccacagattctacttcgtcagcataaccttgccgtactgcttgct

SEQ ID NO: 6767 - DNA, 253 bp, Bacillus thuringiensis
ttaaaagtattatgtattaatataattggtggtattttctgttcgtatgcatttgggatcactgaacacgcgtgtttaatggatgaggctgtacgggagacattccaagccaaccctgtgttgttacccggggctagtggaaaagcacttatcgcgccgaatggcgccacaaaacaacatacaacaatgaaccctagtgtaacgcccgcttgaaagaatggaatctaaacatgcacactgcttgatacatggc

SEQ ID NO: 6768 - DNA, 239 bp, Bacillus thuringiensis
gatccacctggtggtaaactatttgcaaacggactactattcattgcttgcagttatgcaaactattctcgaaatcatatggatttcatgtgacgatgacgagcataaatcattccgtttgggaaatgcaggcatctaagctatagaaagagggattacatcgagaattgctcgaactggtgcaacggaagaagagaggcgtgttttacgtgacaaagtagaacaagcagagacagaaa

SEQ ID NO: 6769 - DNA, 438 bp, Bacillus thuringiensis
taacaagttcgaagatacaacttacaagcatgctcttgttcgtccgtttgactactacatttcgttgtactactaaaagaaaatttactattattcaatcgaacggcattatggagctggaaacaaatgtaaatacctcatgatcatatgaaccttgtagctacctaaatggcttttaatagaagtcaaatagcgctcgcggtcttttgcatacaatccagagcttaagagaatatcggttttaatgccgcacatacttgatcgttatggagtagcaagtagacactttatatacttcataacaaacgctctactaaaacttgcgagaactgtacgaagatgttgagaaacaatacattgcatgcgttcatatacatcctgcagctgagtgacatttcacctaagctcgtacttaagtttctatactatacgtgcacg

SEQ ID NO: 6770 - DNA, 195 bp, Bacillus thuringiensis
atccaattcggattgccacatcctttcccgtgcgattttaaggcgaccgatcgcccttcacgtgcacctgatggaatgaatgagctatatttgtaaccgtaattgtatactattaaccaatgcgatcgaatcttatataagataccgatggggggtgtcgtgacagatcactattaagaacggactcacgaaagc

SEQ ID NO: 6771 - DNA, 172 bp, Bacillus thuringiensis
catatattacgaaatttttatactaccagcaagaaaccttttacggggggggggttcattttgactattatacaggataaaaacataaagggtgggtattaacaatattctaataaggctatatggtaagggattgcgaaagaatagaatcatataatcacaaaagttgcag

SEQ ID NO: 6772 - DNA, 203 bp, Bacillus thuringiensis
accatacactaaagggatattttatgtctatacattatacttattcaccaaagctgatacatcgcatggcaggtttttaaaaccttttttgctgacgggccactcctctccaactaatttattcccctttttcctaagtcgcaatttttaagagactccctaacctttactcaatttccctttaatcttcgccagattgttga

SEQ ID NO: 6773 - DNA, 444 bp, Bacillus thuringiensis
gaggaggacatgctcctttcgttgcttgtcagcctttctatgaggccatcatgcttaatccttctggtgactggtccaacccagagcgaccataaacctctgtaatcgatgataaatacacgatgcgcacctcaacatcatccgcaaagcgatgaccagtgaccagtaaagtgggaatagtgatgctccatacaaagccgatccgccattaccttgagtggagagtgcaaaggtaccgcttggaacgcggattatttgttgtggacacataatatcacggcctttggtcataaaagccggtacaaactgttataaacacgaaaatagtatcagctatcattagaagatatcggcgcaactggggctatatatccgtatatcggaacccttaggcgtgcctcggaatatatcatcgaccattaaaatatattgacttaccgacag

SEQ ID NO: 6774 - DNA, 300 bp, Bacillus thuringiensis
caggttcttcggttattctcaggtggctgtacaaggttttgggtctaactactcgctttcgctgacatactaaaagcaatgttggatgatggacaatgctacattttcgaactgggataaattgggaatacctgtttgttatatgggctctagtttttaaccaatgggccgctaatagaagaaatatatctcaaggagactattacacactatcaggggctactggtgttagctgttggcacgcgggatcactatgtaagctctggagcgtcagggtgaaacggggtatacgtcattaca

SEQ ID NO: 6775 - DNA, 262 bp, Bacillus thuringiensis
ttagaacgttgatgactaaccctgcgaactctccatcacggtgtagtttataaacaccgtttacgctaaacaaagccataccagacgggaaaaggatacgtccaagggtaaggccctggaaatcacctaaacgcatcctgtgttcaaaccctggcagataactgatcagaaattgcggcgtttcccattaacaagaccctagatttagaatatgttactgcaggtggagcaaatgaaagcgctaaatcgtaaacaagagccg

SEQ ID NO: 6776 - DNA, 175 bp, Bacillus thuringiensis
cgtaccacccgcgtttatagctcccaacccagcaacacaggcaggggggttttctgcgaagactctatggcgggccttaccaaacgccccaaggacacttgttacaccgcggtttacctcaatacctgaatgcatcgcttcttcaaagaattaccactagctcaccagcaagtgc

SEQ ID NO: 6777 - DNA, 203 bp, Bacillus thuringiensis
cgatccttttgtttgtgattcgttgacctcttcatcattggcagtatgataggctccgcagactctaaagcaagcgttatcagacgggacaaggatgcttcttagggcttgcttttcgataatacctaatgggatcgtttgttcaggcccttccgttatctgaacaccaggcggtgtgtgtctcatttactaagagcgtttct

SEQ ID NO: 6778 - DNA, 120 bp, Bacillus thuringiensis
ttgtccatataggtgaaggcccttattatatttaagaatacactgatgataatgaacgtgttgttatagatggtgacaagactccactatccaagaaagatcatgctgtgatgacctggt

SEQ ID NO: 6779 - DNA, 144 bp, Bacillus thuringiensis
gcttggatcctctagagcggccgctcttttttttttttttttttttttttttttttttcatacaattagatactttttataaccttcaaatcatatggattgtggatcatggtaactttaaagttacaaagggaaatccctata

SEQ ID NO: 6780 - DNA, 251 bp, Bacillus thuringiensis
aatatggacagtgcaaatgttttgagggagacaggttctgccgagtgggcggtcatttcgacggatagacaggcgaaaaaaaaaaacggggcatattaagaaccggctacaaagggaaaagggtatgcgaatgtgaagaagcgccataaaagtcaacaaaaggtgtagaaagcgattctgggaaagcaccatgtactgaccatgttaacaccggaacagatgagaccgctagtagggccgacagtatagca

SEQ ID NO: 6781 - DNA, 223 bp, Bacillus thuringiensis
gtgatttaccaccataccttttctatttggggataccacttaattaagcccacaaaaaaagacagcgaagggggcgcactatagcaaatctttcgttagtcacgacaaacactaactgccactacagggggatacctccgacatcgtttcactctgtggatccggggtcattctatctacttctgagcctatcgggacaccaaattcatcacgataactccta

SEQ ID NO: 6782 - DNA, 253 bp, Bacillus thuringiensis
tcccgggtcgacccacgcgtccggttctagatcgcgagcggccgccctttttttttttttttttgcacaaatggcaaacatcacagggccatatgtagctatccaagagaactgaaggtactaatatggccaagtaaatccaaatgcacttaccacaacttaaattacagaaaacagaactggtaatcttacaacctgaagaggcctttatctgaccttgaatgtggctaccttggctagttatatactacaa

SEQ ID NO: 6783 - DNA, 334 bp, Bacillus thuringiensis
taggttggttctttaagggggcggcctttttttttttttttttttggttgaaaaaaaaaccttttttattttttttttggtttggtttaatagggggggccccaaacccccccccgggggtccaaacacttattcaaagggtagactgttaaattaaaaggtgataaaaaggaaacgggtaaaagattatttttttttttaaggatatttggtccaaatctgggatggccccaaaaataataccttcaggccgcgggggtcccggccttttaagcggcaacggaaaccttggggccaccggcttaagccgcaacggttttgttagggggggggg

SEQ ID NO: 6784 - DNA, 597 bp, Bacillus thuringiensis
taagcttgatcctctagagccgccgcccttcttttttttttttttttttttttttttttttttttttttttttttttttttttttttttttttgggggagtataaaaaattgaggggggcttaccatacccctagaaggaacaaccacaaggcacggcacacaacatagcacgaaaactgcgaaaaaggaccacacataagcccaaccccgcaccaccacaacaaaaaaacatctattcagaaacaaaaaaacacgcctccaaggcaacacacgggggcaggattacacgcaaaaacaatccccgccaaagcacggcaagaagacggcagcaagctaccaggcaaaacaaaagccaaacacgggacgcaagcaccactcatgctgataaaaaacaagctacagcggccggagctcgactccaccgacgggccacgcgggcccttcttcccgaccatcaaagaagccccctaccctaacatgccccagccaaggcttccgctcttttatgagaccaacccaactgaagggggaactggggttccaaagaaaataactttaaagggggtgtttctcaacaaaaaccccccccccccccc

SEQ ID NO: 6785 - DNA, 481 bp, Bacillus thuringiensis
gtacgcttgttcctctagagcggccgccctttttttttttttttttttttttttttagaaacgaattagttttggatcgattcagttaatccaagaattttgttacaactggagttttaaaaaataggatcgagcatattctacaattctttctctgaatcctcctggtgcaactcaacagtttaagactgatttggtgaataggaaattttaagggatccatgggagaagaatccattcagggctaatttattgaccagggaaatgtacaggacccatacatgaagaatcccctgtctttgtgatcccctgcatttcgagaagaccgaacttggtgctaaacaatgagattttttcgttatagaccctatgtaatcctttgttataccaaaccatcccttagggctccaaagctggacgctccactttgtttgcctgaacttcagttccagatcatcttggcacgggccatgtgctttct

SEQ ID NO: 6786 - DNA, 661 bp, Bacillus thuringiensis
tgacgtcccggtccggaattcccgggtcgacccaggcgtccggacgaatcccagatttggtggaattcgttaggtttttaatcggctccagcacttgttttcttgaaggggccaggcacaacgccttttgtacaccatggattttttagcaagtcagagttcatagagatgatggaggagcacaagcaccatgaactgcgacagctaagaagtgacacatctttggaactgggttgtgatgctagaggtcattcacgtgctggcaatgatgcagcaatttggtattgtgtaattgttgctggtcgtccaggtgcagaattaagcaagaagagacaaattttgcggaaggctcaagacaaattgttaggtgatgttgacagaagtgctgggaacgttgacaattcagtagagacatcaagtgctgcaactgccttcaaagatgataggttaacctttgtttggttagatggagaagtacaaaagcaaatttgtgccttctaccttgccactgattatactggagcctgtggccctcgagactttggagatgacaatgataaacctgaaatttttattgttcgattccaaagaaatgcaacatatgaggcactgaaagcttgaaaaaaagacaatcttgggattgtctcagggacagcatgct

SEQ ID NO: 6787 - DNA, 538 bp, Bacillus thuringiensis
  unsure (1)...(538): unsure at all n locations
gcttggatcctctagagcggccgcccttttttttttttttttgataccatatagaagctttgtaagaaccaccaaccaggacaagcattcttctaccagaaaggaagatgaaaagccggggcaccaaagattaccccagaagggcaaaaaagataaaaacaaaagctcccccccgctggccactagacggcataactgtcaacccggaccggcatcgagccgattgtcaccacaccagctttgctcgtcttccggtcagcctccactaccttggaactgattttgaccttctgctcctcgccaccctcaggaactgcgctcccagagccactgactccatttagctgcttctccataccagctgggctagtcttacggtcagcctccactgccttggagcttatcttgagagacccaagttgggcagtgaccctctgctgctcgccaccctctggaacggaactgtgctcgcaagccgctgactccattagccgttnttaggtgttttagtgagcctgggcagaccgctgctgatgct

SEQ ID NO: 6788 - DNA, 215 bp, Bacillus thuringiensis
ggctcgcagggcgtgcccccgcttgtagctaattcacatgattttcccaatttttaagtactaccacaacagagcgggcaatgagactgtttaaatcgttgcccccaacctcgcaacggaaaaaattgcctttcgttggtgacggtcttatcgatgcaccattatgctctaagatcaaatttggggagggagatccgtggtgcatgatcaaatgc

SEQ ID NO: 6789 - DNA, 575 bp, Bacillus thuringiensis
  unsure (1)...(575): unsure at all n locations
gaattcccgggtcgacccaggcgtgcgcggcggacgcgcggatgcggtggcaggcatggtggttgttgcggcggcgctgtctctgctctcgtgtggcggttacacggagtgctgcgactactgcttcaaggactgcatcttcaaggacaagtccatgagagactactgcagctacgcctgcgacaagacctgcgcgcccgacgcccggcgggggcgccccgcggtcgtccccatgaactgccagctcgcctgcgtcagggagtcctgccaccgtcgccgcgcggctgatggcgacgactacacgaagacgaaggcctgctacgggcagagctacgactaccgcggctgcgagaccagtgccgacctgtcgaggcctctgcgcagcaggcggcggtgctggcgttgtcgggcggccagggccagcggagtcaccggaccacccattccacgagaggcaggacgctcacggaccggcggcggcgtcgcccgaccatccatnccacgtgaagcagaagcaggacgctctcggnccggcggcggcggcgtcgcctggccacccgttccacaagatgcac

SEQ ID NO: 6790 - DNA, 166 bp, Bacillus thuringiensis
gagcgttgacactcactgcctttcttagaggctatgtctcgaatacaaagggaaactcccatggatatggagctgcgaaaccactatgagcctattcgggcggcactttagattgggaacacacgacatggaagagcacggacaagtcctggaaccaataaaccaa

SEQ ID NO: 6791 - DNA, 369 bp, Bacillus thuringiensis
cacgtgtggtctgagctggcctaggctagcctggcttggcgacgattgtagaccaatatggatggtttgtggaaattccagggattacagtataccggaggagaggctgaagatcttccgctgtatggacaatggaatgacgtaggaaatacagatgaagtacaccggataacagtactggagtgggaagggaactaagtcatatatattattgatagaagaatgggtactagatgacggtgttactaaggggcgtatattatatacactggaccatatagcaagggtttaagaagatagaggactacaatagcttgttagaacatgcatgggatgaatggggacctttattgagagaagtagagagaa

SEQ ID NO: 6792 - DNA, 133 bp, Bacillus thuringiensis
catggcctttcttatgggcagctattgagaccgttcgtgtgcgccgaaggaaaaaccaagcgtaaaacgttagatgaaatctgaagcgcgcaagaaagcacaaatccactgcgtgggatgccgacatgagtct

SEQ ID NO: 6793 - DNA, 435 bp, Bacillus thuringiensis
cgttaagttaggggagagtgctgttgttaacttgttgtttttgtcagcattaatcgttgcttttagagcatccggtcctacagaaccattttctagtaccaatacatccactccagcccaagcgatattcacaccgtcaagtaaggttggataatactcactactatgtgaatatagatcatcaactcctggcgcggctgcttgttgcttctaatgcgttgtgacttgattttgaataattataggagaatggagtgtcgagaccgtaatatagtgcaccacaccgtgtagttgctctggcgtacaggattcatgggcgcagagaacgagcctgctactaacacaacgcaggaaacatcaagcttgacatgacgaatggcggatactacaacgcctccaagacttttcgtgggatcttgacacgattacaatacc

SEQ ID NO: 6794 - DNA, 122 bp, Bacillus thuringiensis
gtaagcttgtatcctctacagcggccgccctttttttttttttttttttttttttttttttttttttttttttttatttttttatttcactcccccggggtatataaaaaaatttttgccca

SEQ ID NO: 6795 - DNA, 279 bp, Bacillus thuringiensis
tcgagaagggcttgttcgactatatctcaagatctacaagtaacgtaactccatgtattattcaagaggctaacttggctttagtgggatagagtctagtggttgtaacgacaaagcatcttttattagcttggaactagagggaactaggctactttgtgggcagcggtccagtgccctaattagagatcccatggcgatgtaaggacccagagattatggcagtgtattttgtaggtaatatggtgaccgagatatgcccgccgatgatagctttta

SEQ ID NO: 6796 - DNA, 197 bp, Bacillus thuringiensis
ggtttttgaaatttcaaggcattacagttaccggaggagaatgggaagatctttcgctgtatagacaatggaatgatcgttgtaatacaatgaagttcaccggttaacagttctggagtggggagggaactaagccttatatattacttgttgaacattggatacttagagacagtgttgctaatatgtgttaatta

SEQ ID NO: 6797 - DNA, 288 bp, Bacillus thuringiensis
  unsure (1)...(288): unsure at all n locations
aatgtttcacngtttttccaaataaaaccagcaccggcccattaggagggctttaagtgtaatttcgcttaatatcgaaccaaaatccatggctaaaccccaaggggggtacttgccccaggaatatgcgcctaccccaaacacactacggtattccctggcgtataaccaatgtataaagcaaccatttttagggggtgggacgaccaatgcccacaccagttggaaaaccaagcccttcttttttgcaattttaaacatgttttcaagtgcctctgcagcatcttt

SEQ ID NO: 6798 - DNA, 206 bp, Bacillus thuringiensis
attttcagaggttttcctgcgagaggcacaggggccgcttcgggggaattttaagcttaactaggttcgccacctacttcaaatgtgttagagcctgattataatctgaaaaaaggcggtaactctgccggaccagacggtatggcaccatgcttaaccaacaatgctgatcaccattctaacgaacagcatggtaccccacgtga

SEQ ID NO: 6799 - DNA, 332 bp, Bacillus thuringiensis
gggtggcctggggttcggggggcgtggcgccgcttgaagttagttcacatggttttcccggtttttttggacggccacaacgggggggtaaagaattttttaaaggccaaccccatatcttgccacataaaagggtgtcttcgttgcagcggccctgtaaggggcaactcactcatccttttaaaaggggtcgctgggttttcctggggcttaacaaacccggctaaaggcgttggtgcctatattaaaccttgggggggattttggtcgggaaatttggttgcggactgaatttttttcttttttcaggaagggcttgatagaaccccttt

SEQ ID NO: 6800 - DNA, 155 bp, Bacillus thuringiensis
ttttactgtatattttcccctttttaaaacgcggcaccctatggatatattgggcgtctttgagacatttatcgttcaactcatgcaaccattccctctgaaaaagaaggcctacctgatggtatgacacatgaccaacaccgctgtctatggat

SEQ ID NO: 6801 - DNA, 139 bp, Bacillus thuringiensis
cgttttaagcccatttagaaccactaccgaaacagggagcatttgagaccgtttaaccgggttacaccccacaaccaaaaagaaaaaattgcctcccccggagacggaaaaaacgggacaccagcattagcccgggcaa

SEQ ID NO: 6802 - DNA, 427 bp, Bacillus thuringiensis
gccccacacgtttggtctggagctaggatgcttgttaacgaatgcagactgcagcaacgagttcccaaatttttaaaatcagggcgaatggactaatgttggacaatgctggttttccgatatgaagcgcaccaagtgcaccaatgcatgaaccggcaagcataaccgcagcggcaattataatagctaagtcatgaagcagagcggaagaaacggtctgttgaaaggacatgcatcgaagttaccctttctgcttcatagatatggacaaagtataagaggactgtgttgatttccgctttactcatcacccataataaacggaggcaaataggttaagagagggctcaacagtgaagtttgagcatttacaatgtcagaccgtttttagcttatcaaaaagagcttgaaaaactgatgagcttgt

SEQ ID NO: 6803 - DNA, 150 bp, Bacillus thuringiensis
agcccccgggcgcagacgatgagacgaaaacagagcctaaaaagggtacacacagacaaaccaccggggcgttgggaccttttaaggtttacaaccataaagccccacttcaaaggcggcaccaaccgtccgaacaccaaccaccccaaa

SEQ ID NO: 6804 - DNA, 161 bp, Bacillus thuringiensis
acccaccaaaaccaccaattaaagaaccgccgagcactacaccaaaggcaatacaagcacgactgagaagccgaacagaaaaagaaagccaaccttacaaccctcagaccggtcccctcatcgtcttgagaccaaccggcaaagacaaaaaagaatgtcac

SEQ ID NO: 6805 - DNA, 174 bp, Bacillus thuringiensis
cacggatgtgcgcccgaatcgtcccatcctgttggggaattggagttatctaaaacacgtgacgaccctggagtgacagatgtgcagtgtgaagcttgcgaccagacacaagctacaaaacctaccgggcaccaaatggaagctatatcgaaggccttacatggatagtgctat

SEQ ID NO: 6806 - DNA, 294 bp, Bacillus thuringiensis
tcgtgatgtgtctggcgggggactgttaaatagcaccgcttttgatgtgcaatcgatagagcctcttgggcatattaagcaaagaccgcgcgacgcgattctgatctctgcagccgtagcctgtagtccaatatcatggaaccgggctgcaaacagtacaggataaaagaccggtgaacagggtgcccacacgatcgcaatacgaacaggcaaaacaacgttaccggcctcgagggccccaagaaccctataaaagaacttaatgcgtagatcccgacacaaattctggatcga

SEQ ID NO: 6807 - DNA, 272 bp, Bacillus thuringiensis
agcgtgatgttttcgggaggagcctcccatttagggacgtttagtatcggggataaacagatgcccgagggagtgggaagcattgagcgcgggggcgatatattaatacccgcttgataagagacgaccgaatccaggacaagcacgggaaagaaaatggaaacatgccgagtgacaggccgaccgcatgatcacgattcaaaaacggtaaaaaacgtttacctgcgagagggccctcaaattgctctacttgaactggatgatccggaagc

SEQ ID NO: 6808 - DNA, 122 bp, Bacillus thuringiensis
gtgatgttgctaaaatgaattactcaactctgtttttatatttctacttcaacgccatacgcagaaccacggagtgcaacgttatcagttgataagcaagggaatccacaaacatcttttag

SEQ ID NO: 6809 - DNA, 323 bp, Bacillus thuringiensis
cattcgtgatgagataatctgggtaatccagctccgtacccattttgttttgcgatacatagggcataagtcaccagcaaatcaagctgactgagatccaccagagccatcacaaacgtaaccggtaacggacttatcttcattagggcttgtaggaacacgataaataaaacagacgctctgatgaagcaatagcgtgtgaatctaacccagaaacttattattacaccagttgaagcattcgaagcgtgctaacgttttaatgtagcattgcctttaccatcttttaatagatcacgaacatgctgatactgacgatacac

SEQ ID NO: 6810 - DNA, 525 bp, Bacillus thuringiensis
gcttgatcctctgagcggccgcccttttttttttttttttttttgtcggtcaccattgtttttttccccagtgcagcaagccaagtctatgggcaaaatgcatacagatcttttcaccatcctggtagtaccagctagcaactgaggtcaggaaatctactggaaacagttcaaccgtatgcctatcatcaaagtaatataagtagataatttccctttgcctatctaccgtacaacacattacacatctcacacatgcacgcgaattacaggcatggagcaatcaaacaagtgaagctgaggtctttctgcattgcaaagcagtgtccttgtcacaacaatggagcatgatgtattccttccctctttctgcttccagtcctgctcacgatgggactgctactggctgagcggcacacactcgatctcgatctcgacctaccgcgctcgacattctgagctgagtgtgatctctgttgacctttcatcgaaagagagacgctgtcttggcagccacgttgctgc

SEQ ID NO: 6811 - DNA, 388 bp, Bacillus thuringiensis
cgcgtattctgtcggatccgacttcgtgataaactcacaacggcatggggcaccagccttaggacttttttttcctggcaaggccactccggaataatgggcttggagaaaaccggaaggcttgttgccaaacctgcgaaagcatttggaatggatggtttatataccggggccaattgtaagctctggaactctaaggagacttggggccaccgaatgtacggttgggatagcaatcgctaacagggtccattattgccttttgcgtgccttgtagcccaaatcaacctctgttcatcgcggaaaaggaggataaatggtaaaaaaacacagcgtatttggtaaacgcttcccgccccctacttggaagagattcttcacttgctta

SEQ ID NO: 6812 - DNA, 142 bp, Bacillus thuringiensis
gccgccctatatttttttttgcttgtccgttccaatccgttatagtcacccattttattttttattttagggggggaaaaaaaagcttagagggaataatagggccccagggaattataaatatccctcccccatttaaaaa

SEQ ID NO: 6813 - DNA, 286 bp, Bacillus thuringiensis
ttcgtgatctgttgaccgatagttagtcacaaatgaatcattttcttttactgccacgacaaaagcatcatgggccaagggatagactagtacggcatcagcagtcaccccaccacagcctataaagataagaacagatccagaggcaccacctaaagcagcaaatcccgtaccctttgtcaaaagggtttcgtgagctaccaaaaggcagacccttttatcgacaccatgccgaactttacgagcgaaggaccctccagtaccagcaaagcccaagtgcaccata

SEQ ID NO: 6814 - DNA, 167 bp, Bacillus thuringiensis
cacttttctcagtatcatcccattcgtttgctaagacgactcatagtaccgattttcacgggggtcatcttggactctatatacagccacctgcatactggaacacccagctagcttcttgtccacagatacatctttctacttaatatactgattttgtaacgcta

SEQ ID NO: 6815 - DNA, 146 bp, Bacillus thuringiensis
ttcgtgatctggatggctctgttcgtgcaccagttgtcacttttcttttaggcctacattaagacactggtgaggcaggcgtgcaccaagcacatcgcccatcttctgaaatgcacatattctaccgttctggagtacagtactta

SEQ ID NO: 6816 - DNA, 493 bp, Bacillus thuringiensis
gggaccacctacatgcatgtctgccactgccagttcactctctgatggacttctcttactttggggggggagggatgcaaatagcgcgcccttatcaagtgcatatggttttgcaaaacatagagatgggcacgggagcgggaggagcgggaggagcggtacagggagactgagacggagaaagagaaggagcgggcgccgcggtgcgaggagagggaccgcgaggagcgggagagttccaggcggggcggagatgcggatggagaggaggacgactaccgggaccgcaagcggcgccgccggtcctcgtaccaccaccaccgggacccagagccggagccggagcctgcattccgtgaagaggaggaggtggacgccgagtaggctgagcgccggtgccagcggaagaaggaggaggacatggaggccgaacaccagcgccttgacacgagatggagcgtctgcgcctgcgcgtcaggagtggcaggagaag

SEQ ID NO: 6817 - DNA, 418 bp, Bacillus thuringiensis
ggcgccagacggacctcttcactatggacagacacgatttgttttgtttcatcccatgcaatactcttatgttggatttgtttatgcacatttgtacgactaaaaactgcttcaacccttgcgacaagatcttctctcatggaaaggatacgaaacgaatacaccggctccaagttttaatgccttgaccgacagctactggtggatcaccgatctgtaaccatgataataagattgttactaaaagatccgactatcttgcacgtttcccattccttcatctttggcattataatatcgagtagaacaaatttaaggcttcaactctctatatgaaaaatagctgctgctcctgaagtcgaacatgcgcagttatattcacttgtcgtaagataaagcgttaataatacaggcattc

SEQ ID NO: 6818 - DNA, 278 bp, Bacillus thuringiensis
ttcgtgattgccgctagagttcagaataacacagcttctattgtctttgtgagtgcaaaatggccacctgctgcagcttggtatgcatcgctttcaattgggaactgtgctatgccagtcacaccgtttgtcagcggactcacctgtaaagaagggtgttgagacaggacgtcttaaaaacgctattacacgagacacggagtaacgtggacgaaacgggttgacaatagagtacgtttgttacaactggaagcccttgtactcgatttacttattca

SEQ ID NO: 6819 - DNA, 125 bp, Bacillus thuringiensis
acacacgcattattttaatatggcggaagttcagtaggagggggggacatgcaacaaaagattggggtgataactaccaattccgcaggtttcccaggcatcagcgagttccacacaaaaggaag

SEQ ID NO: 6820 - DNA, 107 bp, Bacillus thuringiensis
acaaatgcataataatatctggcggaagttcagttggaggaggggacatgcaacaaaagatcctagtgattactagcaattgcgcaggttttccagatatcacggag

SEQ ID NO: 6821 - DNA, 117 bp, Bacillus thuringiensis
caatcgctcttttgccagcccctaaccatcgtttttaatggggatccagtccattcgcatccccgataacattaccttcaattgaagagtcaccttaaccaacgatctattgcaatt

SEQ ID NO: 6822 - DNA, 248 bp, Bacillus thuringiensis
ggtctattgagatttggtatttggtatgacgggtgtattgccgcacccagatgaattgaatactaaagcgccagcgaaaatacaggtagtgaatttttttaacatttctttttatcccgcaataacacgataggtaaattccttacttattataggcaaaaataagaccttaaattgatgcatcttgtccaatgattaagaagtaatacaattggttttaattacttatgaaaaaccatgatctttga

SEQ ID NO: 6823 - DNA, 299 bp, Bacillus thuringiensis
aattcgtgatgttgtagcgagatgtcgataacagatcgcttttttgtaccaagtatgcaacatgctgtcactaggggtgatgaccgaagagatacctgaacatgagcgttatatggccgatcagttaaactggcagtacgttccgtaggaacggtagttggtattacaactggtaccggcaatggatcaagtagcggatctgtagaacgagggacaggcatcgatggaaagagggtggatgtagatctattggcaacattcaaagtcacgataatgctagtattataggcgtataataa

SEQ ID NO: 6824 - DNA, 424 bp, Bacillus thuringiensis
cctggttgctccgctcgctgcacaacttgctcttttctaaaatgcccactcatgtccaggagcgaggctgtcgggcaccacacttgcccttcattttctgaaatgcagctaatcttcgcttgttgatgactggaccatccgcgatacatcgctaaagacgattgccttcgatcgggacaggagcgacaaggaaccttgatctggaataacgagattcgtattttcctcctaacgagcacctcactcggcgtcatgcccacctccaagacgaaactcgcaggaatcggacaatgcacactcgtaagagccgatcattccgtcgcagtcgcgatttctgcgtaaaggcccatgaaagctcccccaacaggcatgccccatttccattgttagccactgcatgctttgatcttcggagataaaaacg

SEQ ID NO: 6825 - DNA, 171 bp, Bacillus thuringiensis
gatatcgtaccacttgcaatacatgtggaagccgttatttctctaccggcgcattcacacaagcgggggaacttaatgatagaaactctccggcatttcatcaatagaaacgaacagacttttaaacagcataaacctcttaaaaatgagcatacgaaacaaatcctaacg

SEQ ID NO: 6826 - DNA, 307 bp, Bacillus thuringiensis
acatggatgaaacagtcgcggcacatgtatcttttttttaagacgcccactgtgctccatgagagagggtaacaggacacaaacttgcccttcatcatgtgaaacgcacatggagctcgcttactgacggcagcaagatgcatttcgacatagacgggaacaagtgctctgggcggaacggttgataggaagatcctttatttggaagaagatatcctcattccccttgcatgggcaggcgaaggcggcatgcatactcagaagacgcaactgcaccatacggattgtcagtactacagatctgcca

SEQ ID NO: 6827 - DNA, 224 bp, Bacillus thuringiensis
atcccatagtggaagtgtatgcacacaaataagtggtgcgaacttcagctgggttacagatgtcagtaacggaattcctaatatgtgaattaaaactatggaaaccaatttctagttcagtaagaagaacttctttttacctgtacagaaagattactaaaaaaatacgaaagttaaatgaactcaacttacaatgcttcagataaaccaagagtttcgaaacc

SEQ ID NO: 6828 - DNA, 358 bp, Bacillus thuringiensis
atcagggtgagttttcactcgcagtactagatgctcactatatggatgatgctcacctattagacatgtcattccgtgggatgaaaggtaaaattgaccgtgcgaaacaaggcgaatgagttatggcgctctcttactagcgactatcgctgtctgatctgacgacaatactcgcgagttacctgcgatggatgaaaggttaatagcacatcatgtgaatggcacaagtatagattgtgccgatagaaatgacgtggcagcgtattgacattcaggagctagtatcttatgaggggcagagcgaatagtcgatgaacatagactccatcaacatgacaagcatgacatagatcgcgcc

SEQ ID NO: 6829 - DNA, 106 bp, Bacillus thuringiensis
gcttctttaaatcaatacattaattatcaggaaataaagatgcgcggggaaaaagtgtacgaacaactaagaagcaaatgcacctactgtgtgtataagatacatt

SEQ ID NO: 6830 - DNA, 139 bp, Bacillus thuringiensis
ggccatctctcgtaaagagtttttttggctataactagataaatacagctgctggttgagtgaatccatgcgctgggcccggcgctcgctctgaccagcttacaacttactggaaggtgcgcaaactgttataaccaaa

SEQ ID NO: 6831 - DNA, 551 bp, Bacillus thuringiensis
gatcctatagagcggccgccctttttttttttttttatcaaggtaatcccttagttttacgacaatacaaccaatccatcagctccggcctctcggtaatgacaaaaataaagccataaccatatgtacaacgatgtttaacataacgactcctggatcaaagacgaaacatatccgcaggtcagaggactgaaatcaatagccatataggccgataacctagctaaattaagcaacctaccctctatcgaatccggaccgtatcatacacatcttcaggcttcatgctagtgaacatgtcagcttgcgctcccacctgaacgatgagccaaccatagctgcatcttcattcctcagacactggtttctgcctgggcagcagccaataatcttccattactctcaggtacaggtgacccatgagcctgagcatccttcactccagaatgattgcctgcagcatctagctcacattctgaactgagctcttcggactggctagagggagatgaaatattaggttcagcatggcgtcaccacatccacccagc

SEQ ID NO: 6832 - DNA, 441 bp, Bacillus thuringiensis
acgcgtacgatcgatcccaagttggggtagcatcctgatcaacctgagtcacttttttatcatttacaccttgcactctatgaacgtcagaaagagctgttgctactttttgatgacggagcagtcctgcattattctacacggtgatttattgaatggcttcattcactcattgattaaattcttctcatgcgagatacacatacctattaacccgccacagtgtgtggttcctaattgatatccaattaggtatagagagcccataacctttaccggtgcacactcctgaagcacctggtttaccggatcttatatcttgacatattgtcaaaccgatactaagactccttgtgggtggcctcacagtccaagagatttttactgattaaatctagctgctggcacgaactttctctgactacaatttgggcgcgtttg

SEQ ID NO: 6833 - DNA, 212 bp, Bacillus thuringiensis
cgacaatcagatcaccgggaccctagtttttaaaacgagccaagatgcgttgattatcgattatcatcttcccagaagcccttcgcatacctacccaaggtttttttatcataattctactacttatttcgaaaagctttacctgatcatccaatacgacagctgccattccaggttaagatgcggtaaaactaatcacttcgattgcttta

SEQ ID NO: 6834 - DNA, 263 bp, Bacillus thuringiensis
gatgaattggcctttactacacggcttactacagaactagtatcagttttccttcgaccacataccatacacgttgtgatagtgttataacaagctcggactgtgttactcaaaacgacacttcctcggtaaaagggcccaatttgcttgtgaatgttgcctaccatacgctggcaagcagcaggaacccaattatattttgcagcttgtattatatgagttgtgactgacgattgcgcaacctttaattgcttatacagaca

SEQ ID NO: 6835 - DNA, 567 bp, Bacillus thuringiensis
gcccggtccggaattcccgggtcgacccacgcgtccggatttgcagccactaccaccgaaaccaaatggctctcttcctatcaaaaaaattgctagggtgccccggtccttgtctcgcggttcacagtagagcggtggcaccacgtttttcctaatcctcttcctgttctacttctacccatttgttccgtcgcttcaacggcacggaagagaatcgctacccagccaatcgaagtcttctcttgccctgctgtatctcatatcctgttgcgcgagattcttggcgattctgctactggtttttatttttattttgctagttcttgaaatttctttcacgagtgtcagtagccaactgctgataacaacatcctatcgttcctgtagcccctttccgtgaccttgccaaagaatttgctcttctctgtgcgtgtgcaatttcttccgctacagctcaaggatccgctactctgctgttttgggagattcgccatgggcggcggcgccgttaacgaccacttcccgggggccagcgacccgttgctgcccacgaagcgggatggtgac

SEQ ID NO: 6836 - DNA, 338 bp, Bacillus thuringiensis
cgactagaaacacgaaatgtctttgaagtccctttttctttatatggcggaaaggcctaatccgcatcaacgagctcatccgatggtgtattatggaatatcagaacgactgaaaacgcttctaataccgacccactcgtacttgtactggcctgcccctatgacaaactcattcgtctatgcggcgaagaacttatgattagtgcatttgacttagcgaccgatttatcacccaactcgtgggtcaacaacctcattgggtaactttttactgtactcagcctcgtcgtcatggccacccgctgcatgctaactttgaactaattctagcttcttac

SEQ ID NO: 6837 - DNA, 447 bp, Bacillus thuringiensis
agatgtcggattagggaatgtttttgtggaaacaaagagcagaagagcggattggttactgaaacatctgacattaccttcccagattgaaagatcctagattatggcgcgactttcgatgggcggaacatgatcctaataaacatgggtatagcttatggcaattcgaggatgcgcgagttaataaatgctttaatactaatttgtatgaaagacggaatgcccctggtgacggatgctcgtgaggatagaagcatttgcgcagagactggagtgagctaggagtcttggtcaaagacgaaggagaaaataaggatgcccgtgctattaaataatccgacaatggagaatagagatagaatagcaccccgccctgtgtatatgaaagaaactacgattaaaaaatagcaaatcctacagagaaactgaaatattactgtggggttt

SEQ ID NO: 6838 - DNA, 138 bp, Bacillus thuringiensis
ttcggatcctgtctatactgtgccgttaaaagtaattttaatctcgataacttcccctagcatagggtcagatgtacttaaaactatccgtgcctataatcacccatctttatattgaggcgtaattgcaataacacg

SEQ ID NO: 6839 - DNA, 125 bp, Bacillus thuringiensis
ccaatggtgtttatgtattgacaacggtagcacagcgcgaagtgcctgttatcaagggggcaaacatgacgacattgctcaataaaggaatcggtcatcccgcattacgtggcggaggcagtgtt

SEQ ID NO: 6840 - DNA, 518 bp, Bacillus thuringiensis
gaagcttggatcctctgagcggccgccctttttttttttttttttttttttttttttttttttttgtttacttcacatccgatacaatttttttgaaaaagagtcataatgaacgcaactctggaatttcagatttgacacaattatttttatgggaccggagcacttcggtttgggcaaattttcatacctatcgtaaatatacccacaaaactcaatgggatttgggcagaccatggcccggggaacaaattaccaaaaacaaagcctaaatgaactatgaatattttattggccaactaacgtccaagccaccacgaagatctattttcagttgactccccgatccaggcattaaaaggagcactttccttgttgaatattttgttggcatcgctgaagaccgttactacatttggtacaccagcaagaacaatcatgaagatcgccagaattttgccccacttcttggcaaaaccttgggaatccttaaagggatcgcaggtgggaaaaaaagg

SEQ ID NO: 6841 - DNA, 131 bp, Bacillus thuringiensis
  unsure (1)...(131): unsure at all n locations
taaaccgaatagtttacccccaaaagaactgccacccaggacgtcaccttaaaaacaaagtgccgctngaacccccgggggggatgccgaaacaccaccggctaacagacctcaccaaccaggaaagaacg

SEQ ID NO: 6842 - DNA, 104 bp, Bacillus thuringiensis
gaagatggttgacgaattaatatgaaaaagcatgtttgtctaaacaccaaaacggaaagacaccaggggactttattagatataaagggattgaaccaccctac

SEQ ID NO: 6843 - DNA, 123 bp, Bacillus thuringiensis
  unsure (1)...(123): unsure at all n locations
aaagcatcttctaattangaaaccgcnatttttatttttttcggcataaataacaattaagatgaagccgtaagttacaacagtaattggtggcgaaattaaaataaaaaatggttttacgaa

SEQ ID NO: 6844 - DNA, 197 bp, Bacillus thuringiensis
ttacaacagaaattgggggcgtacccaaaaacccaaaagtgttgacgaacacatttaaaaccgacaatataaaactacgcaaaaaagtgcagcaaggaacaacggctacgtaaaaaagcatatggtgcaaagccccttaaaaaagaacccgagacaggggaataaacacaaccgcctgtaaacaaggaagtgataca

SEQ ID NO: 6845 - DNA, 309 bp, Bacillus thuringiensis
tagatgaacgaaaaatgttagtcgctacaactaaacatgacgggcgaccgagggcggttttcatgtagcaccataaagagtagggaaagacaccgtaaagctggtgctgccggaagttcgggtacaagggacagaagtgttttcactaacgtgactgacaaagaaatggttattgcaggaaatggcctggttatatgagtatttggaagtggtatccaattatacaacgacgttataagtaacgagaatcactgaatagaagggacgcttgcttatggcgaagaaattgggctacaacataaagccgaa

SEQ ID NO: 6846 - DNA, 420 bp, Bacillus thuringiensis
tgtacagtttattacagatccagctgtgcaaaaagctatttttatgatgattggaccatgtaaatgtacaagtacgcatgatgttagtgattgtaaacccatagataacgaagctgaatgattactttgttgccacgaaatacgtagtatacgaagcactttatcaacgcacaaacatactatgatttgacttaatactgacaagagataaaaacgtggatcaagtggatcagttgactttagaataacagactatggcaaggcactaacagaccaaattgcacgacgtacttgaacaacaccatcaactgtatggatgagactctgtcagcagcagcaacagcgaatggagtaatgactttacgtactcatactacattaatactaagggggttttgaccaacagtggaccacacaatg

SEQ ID NO: 6847 - DNA, 311 bp, Bacillus thuringiensis
ccgacaagcataacgcagtgattaaaaacaaacaagctgtatatcgtgtgcaattgacatgaagaccagctttgtgcgacgagtgacagcaggtatgatttgcgacataaagaaaaagccgtatgaaagaagatggtcaaatgtgcacatataacaaaaacaagaacgcttggaaatggaacaatgaactgcattgaaggaaagtattcagatattgacgcgtataccgaggagcaacgtatttgcagaatagtatgccaatcggaacagattcatcttttcacattagataaaaatataaagggatggca

SEQ ID NO: 6848 - DNA, 128 bp, Bacillus thuringiensis
cgtcgcgcgcacagattgcagtttagacgggaaaccagacgggccagccgtaggaacgaatcgaaccacgcgcggcgagaggccgaacgagacacgcgagacggcatcgggtacatgccaactgacga

SEQ ID NO: 6849 - DNA, 135 bp, Bacillus thuringiensis
gaacccgacaagagtatatgaatgatgtacagacagcgggacgaacgggttaggtttacagcgtacgctctatcagacgacggagtaagagaggctgaatccgaatcttgttactcatataagggccgtgaattt

SEQ ID NO: 6850 - DNA, 211 bp, Bacillus thuringiensis
tcgtgatctataagggatttatactacatactaaggatagtgtattttacgatagcaagcaccccaccaaggggggactgtattagcataaacatgaggagaagcatcacatgcagatggagttgtaatctgtagaacactccacatgcagtacactgtcgtatgataaagggaggttttttaggaatgggatataccgtatgacaccgcg

SEQ ID NO: 6851 - DNA, 232 bp, Bacillus thuringiensis
caaatggagaagggagggggcttgattcctttttggtcaacaattactcgccaggtgccacattgttaaaaccgccacatacacagtgtttagtgtctcaccctatttgaaactttcaaaattcgtctagaatccacatcctgttatagttctcattcatttatggttacttcattatgaagcagacttacaacgattctgtggtcaatattttttttgatgtatccaaacc

SEQ ID NO: 6852 - DNA, 667 bp, Bacillus thuringiensis
ccggtccggaattcccgggtcgacccacgcgtccgctaatccgatccttaagttttatagtataaaatctataaaccattaccacccctactcccattacatttgattatctttctacttgcatggagctataaatgatctattttcttctttgggttatagacaatctaaatgaagaatgacttagttgacaacttggggtgtcctttgagtagtcgaggttcgttaacttggggtgttctttgagtagttgaggtccaggtccatttgatttgggaatcagtagttcataaacagcgggtacgttatgttcagtaccttgtacttcacttgctgtgccaccttatttgggaatcatgtgtagcataccaccttatctgttaccccattatattgatcttgttgggaataaacaaattttgattccatttactattatttcagtttctgacacataacttcataacagcaaaatgttgtgatgcttttgttactgcagatcagtactctagacatgaactttttgtggtattttgtctgctgacgagaaagtgctgagcttatactgacctgatctcttgtcaatgagtttctgcaatatttgtatgttacatgcattaccacataatttatgcatgatgccgtatacggtagaatgcttgcatat

SEQ ID NO: 6853 - DNA, 201 bp, Bacillus thuringiensis
  unsure (1)...(201): unsure at all n locations
atcttattggggttagtctttntttgaagcatggtgaaaagcgaatgggcaactgcatatccgttgcaagtttatataaaaaatcagactatcgagacacgcgggaagaagaagagagcgggaatgataatgtactagaaaaagatcaagtgaaaaaaatctgtgtggtattaatggatgaagaaaaggtctttttaatct

SEQ ID NO: 6854 - DNA, 172 bp, Bacillus thuringiensis
gatcacaactccgttacagctaactgctcgcgcaactatactttctcaactccataccaccaacattggcgtgccttgattgtaaaataaatgtgacatcaagtctatccagctaatgcgaaaacaagttaatgagccaaattaccgttcctcctatatcgacattccccgc

SEQ ID NO: 6855 - DNA, 410 bp, Bacillus thuringiensis
cttaaaaacgcgtttgctattatacttgtaccagatgataaccatgtattgtctcgtgctgaccgagaatatgtaattcaacttggtcgtgttgaggatactattgccgttgatgaagtggacttcttaattgatgcggcggcattagcagagactgatgatgaacttgaaatggtatatggagatagtagagatcaggtactacaatacggagttagaacaggcggattagttgcagtttcaagtatatgtgcgcttgcagagaaacaaggaaagaatgttgcaaacgagaagtacggttgctgacaaagctctgggattactaagattgaggagagattcacgtcctttatgttgagagatttcaagctggtgtctgggcatgctttatatggggcgtggcaaggggc

SEQ ID NO: 6856 - DNA, 121 bp, Bacillus thuringiensis
cgcacgggccgtttgttagaacagcccacacgaggaacacgagggggacgccgcaaaaaggaacccaagggcccatccgcccaacagggaagccccaaaatacagcaaaaaaggcgagacg

SEQ ID NO: 6857 - DNA, 101 bp, Bacillus thuringiensis
aggtgaaaaataggtgagaaacatttgaaattggcgaaatcgttactggttttgataaaacaggccaatacatcgctgaggatacaaatagcctccctgtc

SEQ ID NO: 6858 - DNA, 227 bp, Bacillus thuringiensis
attcgtgatatctacaataacagttgcagccctgtgggaggtttttttcaactggctcaatggctgccccttggcaatgagtacaaggacgcacaggtataccatgcacttcctgtatacaatatgcgatttgccataatgcacatactgcaatgagtcatgcaatttactggtgcctagtaacgatatgtgactgagaacattgactacagaatcacatgttgctg

SEQ ID NO: 6859 - DNA, 226 bp, Bacillus thuringiensis
ttcgtgatctggacgtcaatacaggtggaccagtgggacttttttctcaactggcttctctgcagcctcacggtgggccgttgaaggaccagcagctgaacacaccacatcatctatggactctgcgatatgccataaaccatctcgtactatgagacatggaattaactgttcttgcgaagcctcatatgactcttgccatgccgacagtttcatttggaactga

SEQ ID NO: 6860 - DNA, 177 bp, Bacillus thuringiensis
ttcgtgatctgaatccggcgtgactggtgaaggttcatgttttcctatccagccttgttgaacaggccaacgggtgggcttgttagcaaaaacacggggataaaccaatcgcgaagttatttatgatagttgcggagcgtgatgaattacacgatcgctggtaaatggacagtatct

SEQ ID NO: 6861 - DNA, 150 bp, Bacillus thuringiensis
ccctaccattttttttgccttgcgcttgacaccgacgtgcgtgggggactacggctaggctgaaggggacaagaggtctagggcgctggtggtcgggatccactcacggaacctctgccccgccgggaacctagggttcaacttacagga

SEQ ID NO: 6862 - DNA, 138 bp, Bacillus thuringiensis
tcgtgatcggattctcacgagtataacaaactatccgattttacttttctccccgaacacgaaacacaatttggcttggagacagttgctataaaaccagctttcaccatttctagcaacgtagcaatagggcgatcc

SEQ ID NO: 6863 - DNA, 198 bp, Bacillus thuringiensis
aattcgtgatctgaagcagactctactaatgaaaatgctgatttttttaccactcttggaagcaaagataaacccgccgattaaagataggtaacaacgcataattccaatggcacggaagcggatcctacttgagcagcgtgacgaactaaaacatcagcctaacacgggaagagtgccgctaatgatgattacata

SEQ ID NO: 6864 - DNA, 168 bp, Bacillus thuringiensis
cccttccaattgttatggagccggtatggatataactcacgtgggtaactacgccgtacctgaatctggaaatacacaagcatgtcttggtatgggtgaccaaacatagaacctttgcctcggtgcaaacctagcactgatcagaatggtagcacaagacaacatcta

SEQ ID NO: 6865 - DNA, 184 bp, Bacillus thuringiensis
taaaacatcgtagaggagggggagtatatgccagctgggagggaagttcagaaaagtgctggcgcgcacccccacacccccctagcccccgacaaggatacgaaaggcctacaggaacggatcctctcctccaatgctgtggagttacacgcacacccacgagaccacgatccggtacaagacc

SEQ ID NO: 6866 - DNA, 144 bp, Bacillus thuringiensis
atgagaaacttgaagttgtttgagaatataccagcggaacgttaagtgtgatatgttgcagaccgacacatcatatttctgctggatcgtatacaggagactaatatccgggcataaaggtccagatacatacaagcgccggat

SEQ ID NO: 6867 - DNA, 112 bp, Bacillus thuringiensis
taaaatattgcagagtagggggagtatatgctagctggatctctagtttggttatttgttgggcgactaagcattatccccggtgatcaaatacatgatactaagaggctgc

SEQ ID NO: 6868 - DNA, 452 bp, Bacillus thuringiensis
atgtttcgcattgagcaattgtggctaagagtttttcaatcttaacctgcctgcacacaatttagcattttggcatacagccagcctgaacgctacgatatatacacatgccgtatcataagatccaacaaatagatagacttccaaagagaaaaacacaaactgtagtaacaccagatgaaacgtattcttagtaacttgtcctgcctgaatcagacgatgcatgaagaaaacaacaaccgctatcatgctgtgtcctgctttcatatcgacaagctgctctacaccaacatatcgaatgaccactaatgcattatacgaagatacattcatacctggagcgataaaatcattgaccgtccccatcgcaagaagcataaaaaagagcatagcaaaaccgaatgttataatggtagcaaccatgaatatgcgatgccgtcggcagcccattc

SEQ ID NO: 6869 - DNA, 290 bp, Bacillus thuringiensis
aattagataaaaacaacgtaattgctactatatttgtaccatattatggcgatgttttatcacgtgctgtccgtgaacaccgaattcaggtaggacgtgttaaggatactattgacctagatgaaatgtacttcttaattaatgcgggggcattagcagagactgaagaagaacttgatacggtaaaaggagatatcgcaaatcagcaactacaatacggcgattagaaatcccgcgtttatatgctgtttcatagatattgtgcgctagaagagaaacaaggtaagaat

SEQ ID NO: 6870 - DNA, 131 bp, Bacillus thuringiensis
gatagatattaaatcctgcacaagatctttttgaggagatggttgctccttggcgacactaataacgcgcactctgattaaaggacaatatttgaaataccactcatagccaaaacgtacaagtctatctt

SEQ ID NO: 6871 - DNA, 476 bp, Bacillus thuringiensis
gcccccgtacggatggtagcctcttgagcggcggccgtccttttttttttttttttgttctaaactacacgtgttctttatatagttgggatgcgggccagcagcccttgggggcttcagcacgaagccaaggatcatttacccatcttcgtcatcgcagacacattacaagcgatcgcattaacaacccctgcttcttggcagctaagcagacccattacaagcgatcgcaaaccttgttgtacaaacattttgtgtagctgtacacgtctatatactagtacccaatacctgcagacggccacaagtgggctacaaaaatgtacagtttgaaacgcgactattttatgtagcacgaactggtcataagcattccatttatttgaagctcccatctcccatcgaagaatcacggaccattggaagaacagaagctatcagcatccatcatggggtcgccaggaacacgagctagc

SEQ ID NO: 6872 - DNA, 129 bp, Bacillus thuringiensis
ctgaaccgggctacagctactgaagatgcagatattttctcaccggttgcggggcaaggctaacgcttggactatggctctccactgccgaataagaccattggcatggatcccatgcctacatgagca

SEQ ID NO: 6873 - DNA, 104 bp, Bacillus thuringiensis
attgatacatttcactggagtctttgaacaatcagctcatgatagttcactatataatataccctgaaaccgaaatacatccgggaaaagatctccaacaggca

SEQ ID NO: 6874 - DNA, 221 bp, Bacillus thuringiensis
aaaacaaccaacaacccaccccacccaacgccgccacacccaacaccaaaaacaaaccaaaccaaccccaaccaaacaaaaacgcgaaaacacgcccccccaccccccaaacaaacccaaccgaaacaccaagccaaaaaacccaaaccacaacccaaaaaaaaccaacaaaacaaaccccccccccaaaaacccccaaccaccacacaaccccccgaaaa

SEQ ID NO: 6875 - DNA, 549 bp, Bacillus thuringiensis
ggtcgacgcaggcgtccgcccacgcgtccgcacccgcttcacgtggccggttcttcgcggctgaccggatcgttgagcccggtcgtacgtacgtcgcccgctgccctctcgtcgtcgcaccccggcattccccattcccgttcccgttcccaggcaggtacgtgctcggtgctcgccgcggatcggtcacgattcacgcgctacgacgacgatgtcatgtgatatgatgtatgtacacggccggcgccgccatcgtacacgtactccgtgtagtgcgttgcttgcagttgcggtgggcggcggcggaggcgtcgacgaagcatggggaaggcggggcgctggctccggagcttcctgtcgggcaagaaggacaggcaggcggcgcctcccaaggacaagcggtggagcttcaggcgccccccgccggcggcgcaggaagggaacggcggcggaccagcaccaccatgggccgtcgctcggtctgccggcgccgggcgtcgacgagctcgacttcgaccagaagaagcacgccgtggcggtggcgcgcct

SEQ ID NO: 6876 - DNA, 386 bp, Bacillus thuringiensis
agatagtgcccttttttatatcttaatgccaaacgcattgcggggggcacgtttacgagttgtgctcgtaacaaaacaaatgccacacggcatgctgtacatcccaagttgtatgacgcgcgtgcatgtggtcacaagttacgggccgatataataaaccgtttagtaaaagagtacacgctataccttggcgctcagacagctcaatgattatcgtgaaactggcatgatgaatcatgcaaagacgaattgtacattatgaaggaatggtagtatacttagtcacgatttatatgcattcattatgcgagatgagttgtattatatttatcgcactgcgagtagcgacccatctagtaatactttcccatgggcctaatgatcaa

SEQ ID NO: 6877 - DNA, 292 bp, Bacillus thuringiensis
cgcgagtcccttcaaacccaattgagagcacgcgtttttcttgtggcgaacacctaaagccgactacggatggacaaccgtcacttgggacgattcttccggcattaggatacgggggaacttgacgcacatccgcgtcttaaagggcataccctcaagaagtgccgagccaccatgacagtaccggcacactcattacgttcgaccgcgtgatatgagaaagcaataccgacagcaggtcgtgaggacaacacttaaaacgtacaccgttgcgagcgggattcgacatgcg

SEQ ID NO: 6878 - DNA, 131 bp, Bacillus thuringiensis
agaacgcgtttctttttctgcaggaggaacagcagcgcggggggagggactcggaaaaaaggaccgcgcaaacggcgcagcaacaacagctcagcgagaagaccgtgaaacaaaacacaggaaaggaacag

SEQ ID NO: 6879 - DNA, 318 bp, Bacillus thuringiensis
tcatatgcggtgaatggagcgatgtgttctttactttctcccattaatggagagcgacccacttgtggctcctttgaagagacgaatgggatacctccatctggatctgcgttcttaacaagtgcagttacatgaactttctgttagccagagtccccaactaagactgctacaccttttggttagctgctagagtaataaatttaatcgcatgcttactctacaatacttgaatctttcatatgtgacggctgcctgctatttatgtctcctctactattggaacctactgtactggacataggtgaatgattcatg

SEQ ID NO: 6880 - DNA, 228 bp, Bacillus thuringiensis
attgaccaacgatttttttaccatgaaacgctgccacgggttgtaccgggagatgttacacataaacgaacacagttggaggtgacaattgggtcactacagaaatgtaaggcacattcttacatggtttgagaaattaccgttgttttaatggagctgatgacacagacaacctatacttgcacatttcgctggcaaagggtaacgatgatacaatattgccaagtg

SEQ ID NO: 6881 - DNA, 404 bp, Bacillus thuringiensis
tgacggtactcccttccaccgttctttcctcacacttttgctccagcacatggaacttgtatgagggccggatttatgtcagaaagggatctgtctctcacacggaagagtctatatgcttggacgcctgccctattgtgcaagcaatatgcacctagcggagagacttaaccatgacaccttgcgcttgccgatacctacatgccgcgcatgggtagatgctatagaatgactccgttataaaagagcacatccagtgaaaacatgctcccacatactatacttacctttatgacgtacacatcgtcgtaatacttaacgagaggaccagttgactacgtatgtacgccaggccactcttctgctggttgcattatgggcggaacaatacgattctggacatt

SEQ ID NO: 6882 - DNA, 446 bp, Bacillus thuringiensis
ggtgtggcatgcgcgccacctagtctatgccgagacttttgcgtttcagcacgagcggggcgtgatccaagcatgtccattctagaatcactacgagcctcatacattgagagataacgggtttggacatatgctgcatttactgcataaggattaggacttggagagaccagagactcgataatccattctggatctgtttgtgtgcctctgaaggcatcgataattgcatccgcacattctgatataaatccgcaccgtccgggggatggaatggacttgtcttgaacaccttgtacatactgataaccatgtgggatttccgatataccatcatgtgaatatcgttcataccttaactcacaacgagatgctcacagtgtggcagcctctttatccgaggactatggactgctcattatggtagccctacttaagaaaaggca

SEQ ID NO: 6883 - DNA, 296 bp, Bacillus thuringiensis
acggagttttgtgtctgtcttcttgtccaggaccgcaacgagtgggtcccttcattgagcgaacgcgacctgagggtaatattgacgtccgcaagaggatgagctattacaatcgatacagacactttagtcaggtgaaacggacacgtgccaaaaactgttatgaatggcgaatgttccaacaccaaccgcagatggcaaatgaaatctggacgcaaacagaaccgttgggaatagagtgagctgcctatgcaccccatctagaatctgctgactcacaattaagccgccaagcc

SEQ ID NO: 6884 - DNA, 273 bp, Bacillus thuringiensis
ttcatcagtttttttccgcgagcaagctgagtggcttacagtaggtttcgaaaaagaccctgatagattgcttggcgaacttcttgctgagcagcctggactaaatgatgtaaagtacacgcctggtacattgcgcgtacacggtagatgtcgctgcaatctgtacagctaacactagttcagcatgatataggaaccgcattcatcggagatgacaagggtgcgtctcagaggagtaatgcgcttttacaggcgaaggatcagtaacacatg

SEQ ID NO: 6885 - DNA, 377 bp, Bacillus thuringiensis
aaacagcgtttttttcagggcgtactcatacaaatactggccagcatcactctgatgtggctatggctagctcaatagcgataggagtcaatgcatcgaatgtgtgggccaagcccataactcgagaccgaacttggattatgacaatggtggcctgggatacttacggcgtgagagaactacatggaacagttgctagaatggcccgccttcgggacctcttacgcgcaagggcattgacgccgtgactaacagacgcagagctctggcaaaaggggcacggcgcaccgctttctgtgcagtcccagcagcaggagaaacgccccgtagcatggcccgcgcgttggggacttaacaacaggcaggaaaacagctga

SEQ ID NO: 6886 - DNA, 301 bp, Bacillus thuringiensis
tacacagaagattttttttcattcctgaatcaggccacaacccgccgtggatcattagtgacatatctaattttaaatgcttcgaactctgggcgagtgatgatatttgttcttatggttaggaaggttccccaagtggatatttcgttctgggtaacaaataggccagatgattaacttgtaaaggatctggtggatcaagtgaccgtcataattgtacatgttatcaagctggaatctgcgctacttagtgaagttatagcacaagttgagatagaagaattcatgatggagcaggctt

SEQ ID NO: 6887 - DNA, 165 bp, Bacillus thuringiensis
aaacgcaaatttatttaatgccgagtgatacgtttagagtaggtctactattcaagcactgcgcataaagatgacccgtttatcgtaaattctgtaaatcgctcttacgtgcatggaaccatgctctccagatttgtaccaatctcacagtggtcttgagctttt

SEQ ID NO: 6888 - DNA, 210 bp, Bacillus thuringiensis
tagcttttcagactcgctagaaaacaaacgattgtatatcacgggacaccagacattaagagggaggaagtacatgaagctattctttcaaccacttttcagttaaaagaagggctaaggtataatgttttctacaaaaaatgcagacaagcgaagacagactcatgcctgtaatatgtgtatactacttaagaccgtacttcttaatga

SEQ ID NO: 6889 - DNA, 453 bp, Bacillus thuringiensis
cagcggctgaagtttcagctgcggttcatacagctgaagacggctcagctgcatttgaaggcgcatcgcatatacagtctgcgaccgatcctaacgttacagttcacgggcttgcctatcccgtggccttgggtacatcaggagcgactggacaggcaagtgcttgggctggaggtcttatcaacccgcacatttacgtagctgaatttgctgtacggagagatatcccatcacgagaactctttctatctcagcatgcatcgtttcatatgcgtggcgcgctcactcatctagatgccgtttgatatatccgctcgatgatctgattaactgattgccatcctgctctgacctgtgacgacaccggagctgatagcatgactacgtggctcgctatacgagctgggtactgttacatcctgggtgaactctgtaatactgaacgcaacattt

SEQ ID NO: 6890 - DNA, 425 bp, Bacillus thuringiensis
cgttactaccggccggagccggagcgattaaggctttatcaggtacaccgggggtatcaaatacgtctatgaatttgggtgatattcgtaggtgagctattatcttacgcatactacaagatgtagtcataccttatgtaccagatgaacatgctgctattaaaataccagaggaaatcatggaggcaaggaaggccttgtgtgattacactaccatacgtgtctgtggactaacaggtacattactggctgtaagactccatgaacattaacgtattcatatgcctgataacaagagtctattgggtctcaatgtaccgtattcacctaaagacggctcgtataagacttggaatgacacgctatggatgggaagggtaaacagccaaatcttgtaatgacctaattccatggaaggagaaagc

SEQ ID NO: 6891 - DNA, 255 bp, Bacillus thuringiensis
agacatttatgatgggggacaaaggggcactacgcgggggacgagaggaggaggaaagcactacgggccaccacgggagagaaacgaaagaaggagcgggggaaacacgagaacgggcaagggccaaaccaccgaaccaacaaaggtgaaaacgggaaagaagggggcgataaacaaaagaggcaaccagacgcaaaaccacgaaatagacaaaacagtcgacacaagtaagaaacacccaaaacgaacgaaaac

SEQ ID NO: 6892 - DNA, 100 bp, Bacillus thuringiensis
gagcataacatttagtacttttactcggtgtcaaaatgacgtctggaaaccagtctaaataacgtagactctgggaaaaatggcgatttgtttcatattt

SEQ ID NO: 6893 - DNA, 310 bp, Bacillus thuringiensis
tgtgactgggcctcacagaccgtgagcccgctgcgtgtgactatgcggaggactgaactgaagatccgctgcattcatgagatggtcgatcacctgcacgagtggcttagagttggcgtcttcatcgcggacggtgaacgggacgagagtaccgccatacccagtgtctatcatgactggcaggcgcgattaggtgtaaataaagctgaataatctcatgggtagaataaaccaaatgatgtggcgcaaaccgtgaaaactattgaaatggaaatcggaacctagcgggccgttgtgcgtccttgaagac

SEQ ID NO: 6894 - DNA, 402 bp, Bacillus thuringiensis
tcccgaatccgtgattgagggcacacccccccaacgtgagtacctaatgttttgcctcccaccacgagtgacgcgaatgtgagcgtcattcatgcgtagcatggctctgtttgtttagcggactattcgaatcgatagaaacgcggccctactgagaaacgcatgtccccctactgcaatgactaaaccaccagttatggcgattgctgatacctcatgctgagaagggtcagggggagaacctttgtccgacgcactagaacacctccggataatacacgcgtacacctcacatactttctattagatcgtcaccatggacgagataatcaaccgaccaccggcatgactacccatgatcgccaggacactcttcatactgatgcaacaaaggccggcacg

SEQ ID NO: 6895 - DNA, 137 bp, Bacillus thuringiensis
gaacgattatggttacacgactcgaggagcggaggagggggcgattacagaggcataaagagcaagccccgcaaaacaggacctaagcccagtctacggggaagacacaagtcacacggacgccacaacgaccagat

SEQ ID NO: 6896 - DNA, 350 bp, Bacillus thuringiensis
gaaggatgttggtttttaggaataagcttcaggagagagtgcagcatgataacattttaatacacgttgcgcacgaaatggctgatgtgttagtggagacgagaacaggtggcgcgaaagagcagaggtcggagcagggagagggctatgcgtggttgaaagaattagaggaagtggcgcccgtgtctactggagaattatcaaaacgcgggggtttcacgaatgagatggagctattgcatcaggcaagaaagcgcagtggtgaattgcagacacaacacggtgagatagctacatgcgaatggggtggacctgcatgaataaatgatacgatttgtggagcgtgtgga

SEQ ID NO: 6897 - DNA, 241 bp, Bacillus thuringiensis
tgctgagctcgctgttctaattggggatggtacagttatcgggctccggtctcaaagattatcacttggagatttcatggcaccaaacttcgtggacatctcaaaaagtacgtcgactggtacaccgggcgatacagggacctacatatacctttgatcaacaaaatgtccacgttggtttccattcacaaacacagctgcgtcactgacatcagaagagacgctgtacatacttaccgtt

SEQ ID NO: 6898 - DNA, 194 bp, Bacillus thuringiensis
acagggaggggtggcgcgcaatacggacctgcgactttggtcaggaaggaatggacgggcatagctggagaagtcaacgcattatatggatgattgagcatcatttggctggcgttagaaccacacggatcatgagatctaaagctatcgattcctgtagcatcgaaattgatggaattagttaatggctgaca

SEQ ID NO: 6899 - DNA, 288 bp, Bacillus thuringiensis
tggggaagggcaacccgcgcttcatagacttgacggtccaatacaaagattaacaaacctcgcagcagaagatctgaaaggttctctgggtgattaatgagaccagaaaagaatgagggtagcccgtggagtaagcatcagatatgaagaaatagaaaatgctaccgagaacggtacattaatttgtgatacggcagggaaaataactaatattgtagcgctatatgaaccccggaaactcaaatcatgttggcgatgaatgcaaaatatggactgcaactagagata

SEQ ID NO: 6900 - DNA, 101 bp, Bacillus thuringiensis
cacatgctcctgaacgattttgtatgcactgctagatttaatacccagggttagcacattagtacatttttttagttctattccccttgccatgtaaaatt

SEQ ID NO: 6901 - DNA, 414 bp, Bacillus thuringiensis
gccccgctcgtgtgtcagggatcgcactcgcttacttttttcgaaagctcactcggaggggggctaaatgcttatgtgcatctagcgcttatacctttcggacatagacccccaggtatgcgcttggtagaacaagacgatgacaccatgggggcgtccataccggtcctgtggacctgggacaggtcttaaatcaactacgcacacggatagggaccgactgatactactgtaggacctgtgggacctgttatgggctacagtcaacgctgggaccgactccggcaggatgcgaggagcgacgtttgagcgacctacgggaaggagctgtggggagagagcctgttaccccggagccgctcttagacgttgagcgagggccctaacatgcggaaccaccagatcactaagccc

SEQ ID NO: 6902 - DNA, 340 bp, Bacillus thuringiensis
gagctctataatagagactccaacttcctattatttttccaccagagcgattactggaaccggaggcagactaaagaccacaggatgatgaaaagacggagacggattataaaatagagccattatactgaatgtgagatctatgaacatatgtattcagtaacccgatctaatcaaatgatattccaattaaacgatctccagcttattggaaaacatctagagtatgtacagcggattgaatatataataagattgatgcccaactggagcgaggcagcatagagaggcgtaccgctgactggatagaccgttaaactatcggtatagaatcgggtga

SEQ ID NO: 6903 - DNA, 506 bp, Bacillus thuringiensis
agaagtggtggatatcaagagtgttgcaaaattagattatgaaagaaaggaagcctcacattattttgtgaggcttccttccttacaacttcatggcgctccaaattgtccatcgatctctttcaataataggagagacgttttgtaatgcggtctgtatatgttgtagaagttgagaaagttcatcatctgttaactcatatagaatggatcgacctgttcgaggagataaatcttgcaataatgtttctacagaatcatgtatttttcgtatttcccattgtgtttgtgtgggaagtacatgaagagaatgtttttgtaattctgtctgtatagtgttggtttttggacgtctttttgactctatttcaataagttttggaaatagagagaaaaaatatccgcgaatgtgttcgggacttcctggaattgtacaatcttcaatgttcgatcttgtaaaataagtacaccgtttttatttaatatacgaagagcttcacgtaaaa

SEQ ID NO: 6904 - DNA, 104 bp, Bacillus thuringiensis
ggaaggcatcctaatttaaactgaaagcagggcaaacggcaacgatgttattgtggcgccgctccaatcgacagctcccatagatctaagccggggacactaca

SEQ ID NO: 6905 - DNA, 352 bp, Bacillus thuringiensis
actaaaagcagaagcataataaaacaacggtgtttccatctgcgtaggacgatatagaacgattgcgctggtatcccaatgatcaccatacgctggatgaattgttttgacacattactacggactgttaacagagatcatgcctgggctatgctgaaaccaaacagttcgagacaaatcagatgatcgacacaagcctcaactgaatttattacacatgtacttacacgatattatgtccatgaccgaccggcatgaacgtggacagaagtctttactttgtggacagagacttgaaaggcattatccaaaggatggaccacatcaaatgaacgacactcatagtggagca

SEQ ID NO: 6906 - DNA, 253 bp, Bacillus thuringiensis
gcataaacgcctggggctgccttgcgtggtccactctctttttaaccaacaagccaccatggaaccaaggggttattaaggatgtgtaccgacgtatatagggtaaaacgtggctagccagtggaagtggatcccctctataaagaaaacgttgcacatcgtccaagggcgaaaaaacatacatgagggcgatcagccaatacaggaacgaataccacaataaatgaaccagagggcggggggcgagccagga

SEQ ID NO: 6907 - DNA, 313 bp, Bacillus thuringiensis
tggcggcagctggtgttttgagatggggggtattgtacgagcacgagcgcaggcctggctcttagtcgccttcagcaagtggggcactctaaggagactgccggtgactaaccgtgagaccgcggcgagtgacgctagatattatgccccgtacgaccggcggtcacactggcgtcaatggacggtactggagctgctgcaccgcgaggtggtgctcatctcagacaaggcgatctggatcaggttgtgggctgcgactacgctacatgtggctgtattacctagccatcgcatatcaatatgccgaggggaa

SEQ ID NO: 6908 - DNA, 454 bp, Bacillus thuringiensis
aaccagttcattgctcgcggacctctgtagataccctctatgaggagatcgtgattaatagagtgggaggcttaatgtacaaccatgctgttcataagatacatgctttacctaacacaagacacgcagaatatgcccttgtataacactgtacaccaacggtgggaacatacagtgtctacagagctataggacagctactatcaactacactacgcaccactacctaacaggaccggactgaataacgacattctgaacccatgtcgtgtaccgttctaatgggcaagacagtcgaaccctcggtaccgacttcggtcgcaagatgcgatgagccgactttgaagtgccgagcgtccccatgattgccacctcttggtggagagaagcctgttctcccgggagcagctttcatacactgagcgaacggcctaccacgcgtgaccgacggatc

SEQ ID NO: 6909 - DNA, 367 bp, Bacillus thuringiensis
tgatgtcagcttgtgttttgagatgtggtgttatgtactgaatcgagcgcaaccctcgatctctgctgccatccttacggggggcactctcaggacgcctgctgtggacacaccacaagatggtggtagacggcatggatttgatgacctatgacctggctacacattgctattgggacggtacagatatgcttgcatgaccgagaggtgatgctattctcataaaactctttctatgctcagattgctggctgcatcacaactacgttgagctggagtcgtttgtaattgcggttcaacatgactgggatagtaccttgccgatgcttgaacactcacaccggtacggcttgtgagtatggaacac

SEQ ID NO: 6910 - DNA, 175 bp, Bacillus thuringiensis
gttcacaaagctgaataatttttgggcttgacgatctattagcagttacaacagaccttatagcccgaattctctaacgctctcattaggacgatctttagcgtcgatcgcagtttgcatccaggctatttgctggatcttttacaggtcttacaagctatgtaattgttccaac

SEQ ID NO: 6911 - DNA, 337 bp, Bacillus thuringiensis
gcgtccatagtaatttgcccttccatataagaagcatacttatctttacatacccgttttaaaaaatgcggacctcattaatcagactgaagataatcatagatcttacgtttagaaaaggtgaggaaggctatacgtatacgacgcagaggttgactgatgatgaattgtacgatgtctatgtataggagacgaggctatcataaaatcctttaactttaaataaaaaggagcctggtatacatgagatgaaatgatgatccatatctacatttgatgttaatcaactcgtgtaacaattccacgtaggagtgctattactattctagtgcgtcat

SEQ ID NO: 6912 - DNA, 127 bp, Bacillus thuringiensis
tctgtcgatgttccacctaggttcacccaattaattttgtacacgtttaaaaaggaagacaagacgtacagtctccaatagacgccgctgcttctactcagagtactggacatcgcgaaatatgtgc

SEQ ID NO: 6913 - DNA, 163 bp, Bacillus thuringiensis
aggatcattagtgaaggaaaagagatgaaatgttaaaaggaaggtattattacaaggttagctcgggtcgcaggcgcgactgtagcttgtagtgccagaacaaagagataagtatatggagggactgtatatatgatggacggtggaaaggatcttagtaatg

SEQ ID NO: 6914 - DNA, 397 bp, Bacillus thuringiensis
gagggctgatccatctctggctggggaaccgaaatttgtttttcataaagtacggataataggatgccgttgtggttttattaccaagggttccctatacgaatgtggaacagataaggagaacaatctacatcaactatatgagtagccggaatgaacaggagatgtagctcgtgagtaatagaaaagaaagattggggaacagaaaggcttacacgaagttgcctatggcgttcatagcaatatttattctaccatgcctcatcgtacgaatatgatccaatagcaaagcaaagaccgatgttaatgtaacacctacacaaccacctaaaaatcacttaattattttaaatcagcttggttgttgagcattagaaaagacgcactcagatttcat

SEQ ID NO: 6915 - DNA, 461 bp, Bacillus thuringiensis
tcaagcggttcgcatgacgcgctaatcgcgtctcttgcaaagctagtctgtgctgaattactcgagctcggtgaattaccatttgggaacagcgagagataagtatcattcatacatggcacccttctctttgccaacgccgcatgggttggcatcattattgccggactttacgatgcccagttgacacgaacctcataatcttagcgctccaatagaacatgtatcggtgcagtcctgttttgcatactagctccttggaaagcacgcgccttgggttataggttatactcgaagcttatggcggatagatcctatccatgagccgatgaattatctacagcgagatgtatggcgcccacatttctgctaaaactgcacatgcaacatcctttcaggcaactcactctctgtacaaatactcatcttcttgaatcaaagcattccttatgatgatcgct

SEQ ID NO: 6916 - DNA, 301 bp, Bacillus thuringiensis
ccctcaacgcggaagctggtgacaccagatgttttttacgaaaactaacctcggggggcgctatcagaagatatgttttttgccctcgattcccttcgggattcgggcctactgcttcctaagcattaaggagccccaagaaccgcgtgtgaggatgattatgcataggaatacgacgcctcacatgcgtatacacggatttttctgaagccgcttgattaacaagagcgctcgctttcacgtaaagacggtaaaatacgtatggctcggcagcacgtgttactgtgatatctagaacagt

SEQ ID NO: 6917 - DNA, 300 bp, Bacillus thuringiensis
gctgatggtcactattatgatccggagggtgatacggcgctagttgttcgagctgcaaggtcagctgatgattctatagatgaagctcgagaggtgatgatggctggcctttctgtacccagtgcagggttaacgccagctgcttcgtttgtagcgaatgatggtgatgtgtatgttgacgaactaaccagcaatgccaagagatacaccggtcaatgtgttccctctatgatgagggcattctgggatgccgtatcctgaattctttgatgagctaatggggtgaacgagtgaacgtga

SEQ ID NO: 6918 - DNA, 106 bp, Bacillus thuringiensis
cttccagggggttttttttgatataatcatagtactgcgcggggtggacatttttgactagaggcttgcttatggtcatgctcctttggggggccgagtttatgga

SEQ ID NO: 6919 - DNA, 127 bp, Bacillus thuringiensis
gtaatacggctatcaacaggatctttggcaaagctcctccctaaccttgaacggaaaggccaacaggcggacaaaatccggcaagaggcccccattgtagcgcacgagggacgcaccgggggaaaca

SEQ ID NO: 6920 - DNA, 257 bp, Bacillus thuringiensis
tcgtgcgggttatttggctcaaaggttattgcggggattggtgagccactgtattcgccaggatatgagaactcgatgaacttctttactgctggtatgtctgcatttgtcggaccgaaggttatcacataaccattctttgtgggttacgactatatcgggggagcatgtgcaacgattgtacacttagtggcagacttgctcgcagggactagcgtcacgctcggcaggagtacgcacgtgtatctataggtcct

SEQ ID NO: 6921 - DNA, 166 bp, Bacillus thuringiensis
gactggcaagcgtttgtctataaaggccttaatcgcgtgactgatcaattgatattgaaggcggcaatcaaactctactatacaagtaggaactgggggacagagtcatccgtgatgaatttacagtgcacatatctcatgctagtgccaatcatattcatccatg

SEQ ID NO: 6922 - DNA, 540 bp, Bacillus thuringiensis
gtttcaaacattttcgttaatgttttataattatgtacgtttttatgacttgctgctggatgatctttcggaccgggtccccctatttgaactatattttgatatacctcatcctgaaagaatgcatcagggactccgcaccgaatatgaccagatggttttaaaaattcataacagatttcagctgctcttacaccttcttcaaaagtaaggtgttcccatacatgctcagctaaaatagctgaaatagagttgtattcaaatctttcttcccacgtagctttatctagtaagttaagttcatcttcttgcgtttgaatccagcctggattattattaaacactccagctccgacaactactttaatttcgtcttgttttattgccaccatgttcacctcttaaacattttaattcattaatatattctatgtttactattatccttcctccttcaacaaatgtagtaacatgagtccagtacaataccgaactcatgccctaaaaactctctaacgcaacaatctgtctaactctata

SEQ ID NO: 6923 - DNA, 202 bp, Bacillus thuringiensis
gtaaaaggttcttttgtgcagcgattgcacacacatatggtgcatatttacgaacagcacatagatccctaagcagctcaggcattgctgagggcctcaccactaaccggctatgataagatatggtattctgacagggagtgtacctgtgaaatgacggcccatgaggtttgcaattacatacaatccgtaccgatcaaga

SEQ ID NO: 6924 - DNA, 433 bp, Bacillus thuringiensis
ctgagacgcgtacgatcgatccgaatgtcggatgtggccttctcaccttggagataacgtggtttacattgggtcgataacaccgaaaggtcatgcacaaagactagagatgagcgctacaggaacctgggactagtcctcagaataggacacaacgtgatcggaccaattcatggcccgggcgtttacatggatcatacacgcactgaaagccttgatgctgcgacgagcgaccacatccactagctacgtgcactctatgacgtgcttattcttcgcacctgtgtaacgagtatgcttcgccggtgatggttttagctgaaaaggcattaacacgttatagtgacagaccatcgtgctagtatgagactacgcagatgctactcgaccatagtggatctacatgactatatagggacttacaagatatagt

SEQ ID NO: 6925 - DNA, 199 bp, Bacillus thuringiensis
gaagaacccggagacacaacgaccaaaacggacagaaacgaagcaacaacaccacaaagagggaaaaagggggcgaccaaacaagaaatcaaaagaatgcaccgagacagggcagcgcgaccacacagggaggcacacgaggccagtaagcaagaacgggcgcgccaacgccaaaggcgaaacgaacgcgtaggagggc

SEQ ID NO: 6926 - DNA, 179 bp, Bacillus thuringiensis
  unsure (1)...(179): unsure at all n locations
gaaaaaagcacaccaaaagggggtgaattaggcggcccanaccgacccagcgacaaaaagacanangaagaaaagggagcgacaaaagcacaggccagaacagaaccaggcaccggacagaagaaaacaagaagaggcagaggagaagaccgcaaggagaaagccacacgcgaggaaaa

SEQ ID NO: 6927 - DNA, 170 bp, Bacillus thuringiensis
  unsure (1)...(170): unsure at all n locations
caaacaaaagcaccgaaaccaaccgagggggagccagaaagacgacgcggggaccgaggagaacgaagaagaacgaacaaaccacaaccggcaggaacccaggccaaagaacggacagccagaagacaaaacagacgccaaccacacnaaaaaaaacgcaaacgaccgaa

SEQ ID NO: 6928 - DNA, 305 bp, Bacillus thuringiensis
gttcgatccaaaccgaagacgtgatggttaactttacaagttgcagaacaaacctttcgtttaagccgaggaaaaatgccagaccgggcagtgatactgaaagggaaacggccatgttattccattgctcaggttggcctacattggacccataaggcatgtgtttcgcgtaatcataagccaacgagaacaacgcttaccgccctcaataccaacagggctacatagggcaagccaccgatgaacgaaaaagcgctcctgccttgtatgagacacaaaggaagcccccaggccaacaacactcg

SEQ ID NO: 6929 - DNA, 358 bp, Bacillus thuringiensis
  unsure (1)...(358): unsure at all n locations
ttatttaagaaaagataagtggatcaaaggaaccacaacagcgacccggagattagttgaaganggcagccctgccgaaaaagannaaggggaagccgggaaagggcaacacggagcccggaaaacncncaacgcggcgagacacaaaccngcngaaggaaacacaggaacagcaaaacaagcaagcggcccgacgggccaagagggaaaagagcgaaaacagnnccaaacggaancagnagagcccacgacgacgcaagagaaaaccgcaaagacgacgaccgcnacacacggagccgaaagggcagcagancgcacagcaggagaaagcgangaagcaacccacgagagcgaagaa

SEQ ID NO: 6930 - DNA, 366 bp, Bacillus thuringiensis
cggacggttagtttcagatacggcagaacaactcggaggcggctttatcttgatgcctcgcgctgtgcaccccaatctgaaaaagatggtcagccacaagcccgcctctaacagaagcccccatcctttgaatactactgaaagatgagaatcatggcatggatacagggaggcgatcaataacgcggtcacgctaagcgcgtgtgccagcaccaatacctgttcacgcacatacttgatcgtggcacgtactaccagtgaatccaacgagtgcggaggaatggatgcattggaggcacgacgcgcttaagggcatcctgcctcaatgtttcggcatacacagcggagattacagcttgagaggcc

SEQ ID NO: 6931 - DNA, 326 bp, Bacillus thuringiensis
tcgcctgggctcgttacagcttgttggcgaactcttatagatccaaccgtcgtttttacaagagagggacactagcagagagggcactttaacgccctttccttatttggctgaaaaacattttttggcttctacaacttttaatcggggatcatttgaggtcttagcatcatactgctttctgctgctttgttaacttgagccattcccttactcacaagcacttggtgccttcgtgcatcacttagcgctctgcgtgcatatttctgtcacaagtgtaaccagatgctcactgaccattccaacaatgaccgtctatgtgctct

SEQ ID NO: 6932 - DNA, 109 bp, Bacillus thuringiensis
  unsure (1)...(109): unsure at all n locations
agcctgcatatgccgtaattgtgccgaacagagcgttttttgtagggccagacgcaccacgacccgcnaaattcgncaaagcnacaagaagctgcccaccccccgcagc

SEQ ID NO: 6933 - DNA, 368 bp, Bacillus thuringiensis
cgacaggggcgtgctttggggcgcacacgtacaaagggaggtgcgagctatgacatgaatagccgcgaatcaagcaggggacggacccaaagagggcaagctgagtcatactaaagcgagacgaaatgcggaaaaggcgataggtgcgagccatggagcagagctggacaagattagcactcaagcacaacgggagttggacgaagctacgagtagtattgcacaggaggaggtgttaggaacaacgcgcgaacagatgcatgatacacagaggtccatcgcggcgagggataaacagaacctgtagcgatgacagcactgatcgtaaggggaaaaatgacagacgggaacacggcaagtataatgag

SEQ ID NO: 6934 - DNA, 378 bp, Bacillus thuringiensis
tatagaacttttggtctttagcaaggctggatcacgggggcagaggactgttttaatgcatgcttatgtcaccgcacctggagaaaacatgaaaaaaatagccctccatctgacgaaaaaagggctggtggagggctatttttatgaaacgatattattgcatgttgatgccattcgctcaaatcaaaatggttccagagagcggggcaccctaacgggtatcccagcactctgaaaaaaagagcttaaataacgcccttatatcgcttgattgtaagcgctatacatcaatgatgccatcggatatataagagggatggctatatgactcgtagaagctctttactaaagacgcgtgagaacgtacggctaaatgat

SEQ ID NO: 6935 - DNA, 161 bp, Bacillus thuringiensis
gtgacgcgatatgccggacatgggacaacacagggagcgtttttttttcaaacggcccaaggacaagctacgaacgcgtaggtgctgcgattgatccagatgcttggagagatgaggtgtgcatcattgcaaaaaagcattacaaaccaagctgcgcgcgc

SEQ ID NO: 6936 - DNA, 387 bp, Bacillus thuringiensis
cacgcgcgggcgggagacagcccgcgcaggcgcgggaagccggccgacgaatacagatggcgacattactaggcccctgcgaccgaccacgaggcgagccggaaacgacagggaaagacagaagccccaccggagggaagaagagacgggcacgctcggagcagaacacgaggggacgggaagggtacacaccccgggaagctggcacagaggaggctcacgaaccacgcgggggacgacggaaagggatgcgaacagaagacgaacgaagaatacgcacgcgagcaagcagcaggacggccgaaaaacgccggggctgaagggaaggcaggcgatcaggaaatagaggaagcggggccgaaggcaatgagaaagcaagcagcccga

SEQ ID NO: 6937 - DNA, 318 bp, Bacillus thuringiensis
taataggtgattatgcaccagcaggtgtacgaccaggagcggggcttatacctgccattgctgaacgattcacaccgtcttaacgagatgggcgacctcgtaccaagtcagtgttacctcctatctgaatccgcaattggaaagcaccactgattatcgtggcagattcagcacgtggcaccagacggggtggaaaatactagaggtgacgttatccccgtctagtgcctacagcgattacccgtccaaggtcgggggcaaagcacagaaaccgaatgtcactagctactagattatattaatctcgcataacatatg

SEQ ID NO: 6938 - DNA, 318 bp, Bacillus thuringiensis
  unsure (1)...(318): unsure at all n locations
gagaagccagccgacgaactcagacaaangagacatttgttcacgcacacggcgcaaaccaaggggaagaagcaaacccgaagacggggcaaaagacacacacaacggacgggggaaagggaccgagcaggaagcaacagccaggcaacaacacaggaaaagcgcgcgaccgagacggcagcaagacacagcacaaaagagcaacaagaatacaagccagggagcgagcgcagagagagaaaacggaaaccaaggccaacaacactggagcagacacaacaaaagggatggggtaaccgatcgaccagacagaggaag

SEQ ID NO: 6939 - DNA, 358 bp, Bacillus thuringiensis
tcggagctgcacaattcagaaccaggtcatctccctccgggcggaaaacattagccaagtgattagtttgggaaacccgtgcaccataagcacactgaaacgatagatcaaccttcgcaatgatatacaggacgcaccaaggtactacgatactcatatttgctgaaaaacaaaccctgacagagacattaacagacagggtcattccatgtataataataacacagttcgatcgggcactgaaaggaagcccagatcatgcaacggataccgcggacgatgagactgttcatgtaaccgaacctcaaaaagaacagacagggacgcactattgagccacaagggtccagaccgattg

SEQ ID NO: 6940 - DNA, 176 bp, Bacillus thuringiensis
ctccagacaacacgcaagaatacgagcgtgaattcccccaacatggacatgtactcggcgtctgtctatttactttcaatgagcgagattgtttgctccacatatcaaatgacaacatccgtgcctctaaatgatgcatggctccccaccaacgttttcatcgcccttgaaacttg

SEQ ID NO: 6941 - DNA, 278 bp, Bacillus thuringiensis
agaaagttactgatcaaaagacgagaccgagtaccataggcgatttattcatggagcatatcatgcacggcggaagggatatggactctaccaggctctgagcctgactagggggtgacggctatgatacgattagccagagggtgggaacgggattgcaaacggacaccactggattaaaaaacgagtttagcagcgcacgattagcagactgctaacgagcgccgtattaggcagttgtaacttaccacagaccgatcatatgaacatggaaccgc

SEQ ID NO: 6942 - DNA, 182 bp, Bacillus thuringiensis
gagaacggacaagacggcccacgtgtaccctacacaccagagaccagcaacgtacaagcctgcgcgggacaaagagggcgggacaccaatgcggccattaaagaaacctaacggctcacccacacaaagaaggccaacagatcttggtgcgcaaccaccattccgccagcacgggggaagga

SEQ ID NO: 6943 - DNA, 269 bp, Bacillus thuringiensis
ctcatagttttttggctaaggggagggacattgtctggcctctgtgtgtagggagcacatgttgtcatcccaccgctcgataagagcagttcgaacggccaccgattgtattgtggataaggcagaggtagcttccaagtggtgatctatcgtgctacggtgactgcctacagcaggaataagctaggtgttgctctcgcttcctacatgtgtgaactgatcaggatgcgcgatcttacagtcactggcgggagcgttactgtgtgcgc

SEQ ID NO: 6944 - DNA, 270 bp, Bacillus thuringiensis
cgcggagatccacattgacgatggccgactttggtgagccgccgacaagaggcaccaccagcaagaggcggatggaaagacattaccggacggcacccagctggagccagctgacacacgaaaccccgagacggcagaagcaccagggacgtggatcgcacaccaagatgggaatgacggacagcaacaggaggcgcacgagcacccgcaaaagaccgctagcaaccaaggcgcccaccaacggaaagcaccaagatctgcaacagaaga

SEQ ID NO: 6945 - DNA, 345 bp, Bacillus thuringiensis
ggcatggttactctcggcctggtggccttcaggcactatatggggctgttggagatctacatgctggccaagcctgacgggctcttgcggagaccgcgccccattaacctgaccttttaaatactttttagcatcatgttattagggatgatcttgaggttgtgagtagtgcccaagcgttagaccaggctgtgcatttcacaagtttgactgcgctatagcctagctcttgagcatgaagagcatctgctgataacgggcagtgaagaccgaatgttacgaatgcactagcaagatatggatgagtgatctatagcacatggtaatctatcattgcatgtgaga

SEQ ID NO: 6946 - DNA, 313 bp, Bacillus thuringiensis
  unsure (1)...(313): unsure at all n locations
gaccgcgaaccagcggagcgggggattatagacggaaggaaccgagaagcccacgaagcgaggcgaacgggagagccccaacccagcgaaaagaaagcggacgcggcaggggaagaacgaacggcagcggagcagaaaacacgcgcccgacgggcacacccagaacgcgcggcaaggcgagagccacagcagcggaaaccgggaagagcacagagacgggcgacacgaacccccaaaggaagggggaagaaacagagcccacaccacnacagcaaaaggggacgcccancagcaaaagccacaccaaaggagc

SEQ ID NO: 6947 - DNA, 408 bp, Bacillus thuringiensis
taccgctttgacatatttggccagcggccaccaccgtagtgggagttaaactactattaccactgggctacattgcattaggactcgctgcaggactatatcgtgtatcggaacatcgttcaacttacataaagcatgtcgttagtaatacaggcgatcaggtggctctgacagtggctgctgtagggtcacaagagggacaccagccggctcacccatttgtaaccctgaaccggctgaatgatgacggaacaatggatgctgcacgccggctactataactcggaacgaaagttggaccaagaataacacacatctatgtaggagcacgactgctatgacttcagataaaaccaggtcatacactagtggccccagcgaaacactacggacaaatggtttcaacac

SEQ ID NO: 6948 - DNA, 459 bp, Bacillus thuringiensis
gggtcgtgattgcaatagttgacgctgaacatcatcggttcaactgaaagaataaacaacatagggcaggcaggggtgattgttaacaacgcaatcccagggacaaacccgataaatactgttcctctcgcagggccttcaatcccactaggagcacgatgtgcactatgccctttgctgaacataaacaacattatgtttgaccatctgcagctggccaagtacaactcgagctaatctatatgtggaaagctcaggattctgtaccgataaatgctattaagttgtttaccatgtatcccatcatacatgggcatgatctacaaacgtcaacctggatgaacatggtataaataacatggatggactggactaagaggatttgaccattccggtgaaagttctttagttttctggttccaatgatcaagctctgtagacacagcacctgccgggagc

SEQ ID NO: 6949 - DNA, 100 bp, Bacillus thuringiensis
agcccgagcgtaatacgtctctacagaagctacgccctctagacggcgattaataagaatcggcgctaaagtttgacgtcgggaaacctgcatggacttg

SEQ ID NO: 6950 - DNA, 395 bp, Bacillus thuringiensis
tttgttggaactgccgaatgaatgaataccgctttggttaacggaacgatatcctactataactgacaactacgattatgatcagcatgcctttttcacatgctgaaaccagtcacgcatcatataaactcgtcggaagcaacaagcatctgccatgatcagtaatatgcagaggtgggttatggtggatcaatgataacggtctaagaagacataagcattattatcaattgcagattgaactggaaaagaagatattgtcacttggaacgtaataataacaatatcattagcagcatgaataccgaccgcaataccaccatcagcattattatcaggctgattgataccgttaatcgttacactaccagactcaaacgttagatctattggta

SEQ ID NO: 6951 - DNA, 235 bp, Bacillus thuringiensis
cgggcataacatcacccatttagacttttttgtttctacccaggtcccaagctaaaggaggaggtgaactgtcacaagctgtgcttctgctaatgcgacctgaagcttgtgttaataagcatgatacaaacagctgttgccgggaatgcaataggcagctgcgaaagtaagttcgggctgcaagcgtacgttcctggaaagatctatacctaatgcaaccatcgctgcggtgggg

SEQ ID NO: 6952 - DNA, 299 bp, Bacillus thuringiensis
gaaccatggggcaaggaggcatgcactactacattttttgcagcgggcggcagagagacatgccgtggccgtggtgcagacagagccctgaccgacaactgacggtagccggccggccacgatgtcatatctggttggtgctctcctaaggggaaggaaccttgcggtgcgcaaacaatgctagtggttgaagcaggggatatttattacagggtcaatgagtgctaagactggtcattcatgggagcactgttggcagtaggaacggacaacggttgcgcctgcaaataggcgatttg

SEQ ID NO: 6953 - DNA, 106 bp, Bacillus thuringiensis
cgttacatgtctgatacaggcagcgctatagctgggacgggccacacggtgcagtcctgttcactaatacaaaaagcgtccaacggtggcagtaccataaggacaa

SEQ ID NO: 6954 - DNA, 357 bp, Bacillus thuringiensis
tccggctgtttttacaatgacatcatgctttttattaatcgcagtgatagatggtgaacatgctaccatactaaagagaaatggtcttatacaactggttctttatcccatagtcattctcgtctatacaaaatatgtgcttcccagataagatacactcaatcatgagagaagctactcttttactaagtccttcgtcggagaaatcacatatgaaactgcactcgctgtctcaactagaatttatttggcacactggcttacgcaaggtgcaggttattgagaacgatttcccgaattccttaccaatctacctccattgttcaagaaggaaacaagccatacgcgcagaaaaaa

SEQ ID NO: 6955 - DNA, 386 bp, Bacillus thuringiensis
cggctgttgaggatcttagacgtaccgatgctatggcacctacggaagaaaccaaagcgacaaatcgtccattgacaaatctgcaaaagactgaagcggcaggcgaagaattaagcccgcgagatacattctattacgcatatgaatctacggataactcgaagtatgatgatgccgatcttctatatggaacagttcttaatcaagaccaaagatggtatggacagtacgttcatgcctgtggccagttaggagatagggatgcaaagctaggaacgtgggaggaggaattaaaagcgtcggtgaaaccggtccttgtaaaacgcgcatcaacgaaggatccatccccaatccgagttttgtttcaccgagctgtactagtagac

SEQ ID NO: 6956 - DNA, 266 bp, Bacillus thuringiensis
gatctcaactcctcgaaaacggtttatttgaaaagacacgggtttgcaaggtgatgtctcgcaaccaaacaaacctagcatgcagtgtcccgggtcagattgatagcacgaaatgaggttgccaatcagagccacatgcactgacttcacaaccgcactccaaaagggagaaatggccgctgaagacggatgaccgcattacgctagaatggctattacatccgcctttaacaagggaactcgatagtaatcggccaaccaaagat

SEQ ID NO: 6957 - DNA, 209 bp, Bacillus thuringiensis
cacgacagttctttaatgacggtgcgtgcatttatgttcgcacgcgaagaaaatgcttaggaagtcgttctttgataacactgcggatatacgctacagaagtatgaaactgcgggtcatcacataaacgtgttagcgtcagtttatgaacagaccagctgaacccgggctattgtttgttatcatacatcaggccttcggggggcaga

SEQ ID NO: 6958 - DNA, 295 bp, Bacillus thuringiensis
cacaacaagggggggaatttgaagaaggcggcccttgattcacacaaaaggggaacaaggctataagtcttaatccgaagaccatcccgatggccgtttccctttaaaaaaggaagggaattttcaaacaaacaaaaagggttgggaaaggttaattactggctataaatggcaagggggaagccaatctctgggacccctcaatggttcaaaagaccaccaaccactaaagaaggggttacaaaatacaaaggaaggggggccacaaacggtagaaggccggacaaaagaacaa

SEQ ID NO: 6959 - DNA, 109 bp, Bacillus thuringiensis
tctccaaggttcgcctgtcctagacctcgttttgttttctcgtcgatccacttgtcactccgtggccatccactacctaccaaggcgaccctggctcaacgtactagcg

SEQ ID NO: 6960 - DNA, 415 bp, Bacillus thuringiensis
tagttgcagccgagatactaacagagattctcttttggcacgcaataactcggcaaaaacactgtccctttcgtactctgagcagactgtacatcagcaacagacgctttcacatccgatgattcatccgttgaacggactatcataaaacgtaattgctcactgtctactatacgaagtaagtgacgaaacgattgttgccatatatctggagacgctgaatcattcctatgttgtgcatgaaatatgttagagtgcacttttgctcttgtgacaatgatctgccactaacttggcttcctgatagaagaccgagcgctgaaagatgactcgcgggactgcacgtagaagctcattcgcagtcatccggtccgccgatagaataaatccatgtatccgtagctataccgttgga

SEQ ID NO: 6961 - DNA, 284 bp, Bacillus thuringiensis
actaatcccgcctgaccaaaacgcattaccgtttacattagaattaatacaaataacccgaggaccctcttatagataggaattacccactacaccaaactatttttacattgcatatatgctaataactccccgctcccaatacaacgcattactaccgcgttatcccatagagaagcgtagaagctgcacatcatccataggatatccacgaacatagaaacggactgtatgaaacaatggtttactccagccccctaatttattctaaagctcacgatcat

SEQ ID NO: 6962 - DNA, 253 bp, Bacillus thuringiensis
gggatactgtttttttacccgcaaagattgcagaacggcatgggctataaagaaagcgtttatttgcactttcacgaacaggccaaatccgaacgtggatacagaagttgttgaggactcgaatcacctaggagactaagctgatcctttctcttaggttgataaaactctcgggtacggagacactatcatgactactcagcaaggcgaccatgctagatttaacaaagtggtcgaaagtgtaacggaacaa

SEQ ID NO: 6963 - DNA, 137 bp, Bacillus thuringiensis
cgacatcgcgatcaagggggttttcgaactagaaaaggacggccaatttttatcaacaaataaactcggccccgcgcgcagccatcctaggtaagccccggcccgcaagcgaggtgaacacgaattgggagcccgag

SEQ ID NO: 6964 - DNA, 514 bp, Bacillus thuringiensis
aacatctacaattgaggaataatcaaactctttttgtctgccgcgtttattcaatcgtatcctcctctcattttaaagataatatgaatagaataccctttttgtaccatgcggtcaataattttgttttaatgttactgtaaaataaaattggattattttagattatgaataattaaaaatagcccccttattcaaattgcctagcgaaaaaatcacgttttaatagatttctttatcatctctacctttctatagattactagttatgaaacgaggatcgtttcataactagtaatttacttaattagcttgctggttatggagtagtgcccctataaacaaaaccctccagagacatctataatctgccctgttacccagcggctatcagaagaagcaaggaatgctactacatctgcaatatcttcaacttgccctattcgtccgaacacagatgaaaccgtagcaaaattccgtatttctgaatcatttagcaatttcgcattgatat

SEQ ID NO: 6965 - DNA, 224 bp, Bacillus thuringiensis
ctagataatacttgcccaacgatcaaggcgagctattttacacacagtgtagagctcaaacgctaagaatacattggtgccaacaaacgttgcctagatttctcttacacgtaccttacatcgccggggggaggtctaggaaactctaatgagggcctcaatcttcaagcctgagtgtcagcaaatagggggataaagacacgacaattcactggattttttta

SEQ ID NO: 6966 - DNA, 371 bp, Bacillus thuringiensis
gccgcactttttttttacgcatatgaatgacttcagagtaaataccgagcttactgtgctatgatcgatagtatcagactttaaatcattccctagcacattgacaatactgtacagttcgagggaaccggatacaagtccatcagatacgtagttgactgaaatttttacctagtacatagttccctttacatgagtatcttacagacataacagtacggatctacaggccatttaaagccagcgccagaaaagtcctaggggaactctactaaccgctcagtacgctgtttcacggacttcgccttactgaattgagcgttcgagaccaattgattccaatcggcaagcgttattacgtgttcaccatt

SEQ ID NO: 6967 - DNA, 236 bp, Bacillus thuringiensis
gcatactcggtgttactagctcaacttgcttattaccacgtacaattatcctatccttactaagcggtacatcgataacgcgagaaacaggggcaacagacttatgaaacagacttcgaaagggtccatctaaaatgcgcactaactgcgcatactaaccaagctcaaactgggctactataggaaacatctcatcatcatacgtatataacgaacggctgttaaaagaacgatac

SEQ ID NO: 6968 - DNA, 286 bp, Bacillus thuringiensis
gacacgaggggtttaagaccagcggccgcggtcgagaaagaggtcttattgcataacagagccatgctagctcttaaagacgacatgctagcgaccaagtatactgacagagacgccaaaggtgataatgctggagatggctatgggaaggtcgataacgccaaatttcgaaggtactgtgttctacaacgcgtgcctgtgttcaaaaccactgtgacatacgcactctgggttgaaccagacctgcaagctggagataggtatgctactgtgtggagtgaaatgg

SEQ ID NO: 6969 - DNA, 124 bp, Bacillus thuringiensis
cgcagcctgttttttgacagcaataggcgagcggtctatcgatgggcctagtcttaacgatggtcggtttacttatgtaatataaaaacctccagccagcttccgagcatctcgttcatcaatc

SEQ ID NO: 6970 - DNA, 228 bp, Bacillus thuringiensis
agttcgaaaccggcattgtagattcggattattttttttatgaaggtaaagatagcaattgacttacaaggctgatgataactcaactggctcgacgcctgtaaatttcggattgatcgatggtacttaatcgaagggacagaaagcctcgctagcagagctgcatgatctgtaattggaggcaacgttgtggagcctaggagggctttagaccacacgagtgctcta

SEQ ID NO: 6971 - DNA, 293 bp, Bacillus thuringiensis
cccccatctttgcttgcctgactttctggctgcttgcctgagaccggctgacggattcctaagatctgcccatcatgcctccatggcggtcatgcgggtgtaccgcctgctgcttcgactatattggtcatccgtattcacctgagcttgtttaccatgtgcagattatcccgtattctaattccagtatgcagcgcagctgcaggatgcgtggcagcgctgtctcgctatcgcgggttgtatccgagcactatcacgtcatcggcattcttgtttcctgtgtgaccctgttg

SEQ ID NO: 6972 - DNA, 115 bp, Bacillus thuringiensis
caaaaacatttttctcaatgctggactcccaccaccggctggggggacaaatataactattttacccggcttgaatggtaaaattaaccgttctgaaaaaaacctctcccagaaa

SEQ ID NO: 6973 - DNA, 117 bp, Bacillus thuringiensis
tttgtgaccactcacattaatagtcgtgtggggcactgttaactttctagtacgggcaatcacacatgcccactgacctacagaatatgccagcacagggactgagaggaggtgcta

SEQ ID NO: 6974 - DNA, 487 bp, Bacillus thuringiensis
tcggttcttttatttatgtagattattaggggtaccgttataggatgatcttccaaaggatttggcgtgtccaacttgtgcgaaagagatgaaatatgttgctacaattactcaagatattgaggaacgtggacttatttcagtagttaatttccagtttggggaaatgaatatatactattatttatgtatagattgtttaattataaaaactgaaatacaaaatacataacaagcctaacatattatgttaggcttgttttttgatcgcaacatcattaagaattgcatcaaatatatctttttgcgtaaagttatctgtaaaaatagtttctctggcaaccttaatagtatcgggcggattataccatttttgtaggggaacttcaccaaattcgtgtcgtttggcccttttgttatggcggctaatagttttctctaatgataaatcaaagtaatatgcaaatgcatttttatcaaaataacg

SEQ ID NO: 6975 - DNA, 402 bp, Bacillus thuringiensis
tggagtgtagctccaggctgctacacgagtacacttttgtagaacgcggactccatacgctgagggagggaaagttcgtgaatgagggcggtgctccactacgtgtgcaagcaacctcaactagttttaaggggccattgacattaagagaacgaaaacgtgaccctaactggaacatgacaaatagcgcgtgatattgagacaatgcagaagtgaagagtgaggaaggacactattgtattggaagcgatcccatggcgcctagtaagtgatatgaaacaaatgcgagtgatcgcgcgtccctattagcggaatgcaccgatacatagcgcggaaagagggatttctagacggaaggagatacaactgcctacttgcttatttttaaacaaaaagatccag

SEQ ID NO: 6976 - DNA, 436 bp, Bacillus thuringiensis
cgagggcgtgatagagagtatatctgacacatgtaaagagaagtgttcttgtcactagacatcagcaggggtatcaggaggagctttacccaaatctgcttgattaaaaaggtcaataagggattttgctgaaaatgcactggtaacactatatacattatacagtgaagactccagttatgtacaaggcatagctggatttgttgactatggacttgtgaggagatgtcgctaatagcgtcacatagttgtagcgttcttggtgtactaatgggatttaagggatcgaactacttttagtacacgggggagaaaagtttgcgatacaagcagaagctgcgcatgcatgtatggaacctttaaccaaagaagatgttctttgaagtaaagaaatgagcatcgactaggtgatagctcatattcttgggattgagca

SEQ ID NO: 6977 - DNA, 282 bp, Bacillus thuringiensis
gacacccgttgttttttttgttgcgataatatcggcctgggtcgggggtcattctttaactcatcgctgacacaatctctaacattggaaaacacactgtagttgcgctggaaggctggctaactcaggcattgactaccgtgtcaacagtgtaatggattcagagcatcatccaccgctttaggaattatgcaccggcccatggggcatattgtacagaagcttatcccaaggaaaaactgcttatggtttctccgactgacgggagctgatacatcactt

SEQ ID NO: 6978 - DNA, 232 bp, Bacillus thuringiensis
ggatgctggtgctcgacttcaaattgacataacaccagtcgttgttcctgatgccagacgaacagctgggcctggttaaagtaatgtgctgctggggaatacaacttgcgaagaaagactaaaagatgaagttggagtaggtagacggcgtttgtcttccgagcacgaccatttaactgaagaatgcatttggtgcggtaaccaccgtttacagaaggtgtatcggggaaaa

SEQ ID NO: 6979 - DNA, 352 bp, Bacillus thuringiensis
gttttgctacttttgctagcacggttggtcatcattttctgtcacattatattgcctatgcatataaaaatgtgcgtggatccctgactatctgtttcgaccaactaagtattggtttgggtacaaatataatagatttatatactattccgatcacgaaggcgattgatcccatgaggcttgaaattgtcaatgccatacgttacgtttggttttagcagtatacgagagtgcaaatagaacatatataggtttctaaggatcagtacttaaaacagacataatgaacattacacgctcaagctgttgttgaaagcttaaagcatgtgccatgtgagcagatgtttccaaa

SEQ ID NO: 6980 - DNA, 134 bp, Bacillus thuringiensis
atgcttctgaagtatcgactagcacaataaccccacgattatataaaactactgctaaaaaactaaaagtggggaacgttagagaaggttaccatatatgcaggcggcacaattgttaaaccatgtcacgaggc

SEQ ID NO: 6981 - DNA, 145 bp, Bacillus thuringiensis
tgttccaatccaggattctatccaataaatgaggttaaaacggaggtttaactatacatccacttaaacttccgcaataacctgactgaaacactaagcgatgccaaattctaaagcattgacgtactcagaaactagtcatatc

SEQ ID NO: 6982 - DNA, 256 bp, Bacillus thuringiensis
gaacaccattttcttgttgccggtccagcaaaacaccttcaaggggctatcggattaggaggtgctgccgaacaagacgccatgacataccgggttcgtacttacacgcgcacgaaagaaagtgggacccctgaattccatgccggctatcgttgcggtataagcgaaggcatataaaaattcgggtagaggcttgaattaatagatggaattctgtacaggaccggtgacggagtatgtagccggctcctagcgg

SEQ ID NO: 6983 - DNA, 177 bp, Bacillus thuringiensis
ttacaaggatttcttgctttcctccggggaagcactcgcaagcgtaatccagtcatgacgaagtcgcttaccggatgcgagatcatcttttatcatacgggaagtagtagcgaataggtgtaggaaagacagtaagtatacgaagtgggggaaggtacgtcgcactatgttgctgtg

SEQ ID NO: 6984 - DNA, 154 bp, Bacillus thuringiensis
ttcgtgatggctgggtccccctttgctccacatcacggaactattagtatggccccgatactggcccaacgccagggtagtcgtttgtgccacatggccactctacacccctgaatgagccgtgcgctgcaacgggacgatccaaaaacctctg

SEQ ID NO: 6985 - DNA, 312 bp, Bacillus thuringiensis
ggagacaaagctattgggacagccaggagatcctgacacaacaacgtattcagcaggaactcctgctgggactgtaacaagaacgaagactgtgccaggggcaaaagagcgagactatcacgcgggccaataagatagaaggagaagttgctgactccattaagaggatcaagggagtttggattgtttaaaataaaaatagctaaggaaagtatttttgaaactcgatgaagaggaggtggagctattacgaaaaacagcgattgtagggggtgaaagtgtgagaaaacgtgctataatgagaagcaaaag

SEQ ID NO: 6986 - DNA, 143 bp, Bacillus thuringiensis
aggtacgagcggacacttattttttactgaggagcgcctgctacaaaatgttgtgttggcttaagaaaggcaggctggaccgttcaactacatgaagatgctttggttaacggacaatcatataaagggaacatttgttgaat

SEQ ID NO: 6987 - DNA, 139 bp, Bacillus thuringiensis
tactaggatttgttttctgcaacgaacctggcattttcggcggggatgattttgaagttttgtgggggtactcactttcaatatcccttaccgcctttctcacgacgagccaatccagccatgccccacgttaccgatt

SEQ ID NO: 6988 - DNA, 240 bp, Bacillus thuringiensis
cggatccacgaaggcgtgatcatgaacggccaacgggtgttgtaggcggaaactttttgggaatataaataccaattgctagataagggcgactatggacaaacccagcggctgcaaacgctaaaaactcttataaaataccagaagagactgagaccggggaaccggtaagatacactcgggaacaagatacctgttgaaatggacgggatccacaaacacaaatggggtacgactccg

SEQ ID NO: 6989 - DNA, 178 bp, Bacillus thuringiensis
ggacgcgatggcttggaatccaaatcagatgaccctgaatgctctattcaatgcaaaagacacatagtggagctggaactctggatccgagcggcacacaattgcagcaggcgcggtaccgagctagtgctagagggagtcggatcagggcctggcgtaaacacggccatagctgcgc

SEQ ID NO: 6990 - DNA, 303 bp, Bacillus thuringiensis
cccgccaactgggcgggattggcaccaatttttttttaccccatagacctactgggagaaaggggggactaagagcaaatacaacgacttaataccccaataactcttcaaagagaccagccgagactgaagccggcgaacctggaactacacgcggaactaaaatacctgtagaaagggcaagcaccaacaaacccatccggtacacgattccgacacaagccgactaactgagggaacagaagagcggcaaccacacagatgatcccgagctgtattaacacaacactataaccgaagagg

SEQ ID NO: 6991 - DNA, 209 bp, Bacillus thuringiensis
acaagacagactaactggagcgcggatccgcccccttggagcgacatgggctgaaccaaaagctaaaacgaccacttgaggtgcaatggtcggcccaccagctaaagcaaacgcgagagcgagacgcccacccagaaagccgagcggggaacgtgcaaacagatacggtacaaggcgtgcaaggcaaaatgaattggaagaaggaaggc

SEQ ID NO: 6992 - DNA, 318 bp, Bacillus thuringiensis
aatagaaaaggccctatattttcccccgactaatgcacttccgctctttgaattatgagaacaaactcccgccttagcaagaaaggcagggtttaaagaaatgtccattctattaccaaacaacacccaatattggctaaagtcagaagacaactttactatcatacgactaacaaaaggaaaatactttcaatcgcactgagataacatacaacacttatattggattacaaggactttgttcagaaattcattcatgaaaacgtgcttgtatcactttaaatgctgttcaactactctaataacggctattgccgg

SEQ ID NO: 6993 - DNA, 464 bp, Bacillus thuringiensis
aattaagtcgagtttttttttctacaatcgatggattttctatagatctgcctagtgttaacgcttgtcgctttacttttgtatcatagatttcatcgtgacagcttcccaacatcgtgtcctataatcgaagttcccagctgcttggatgctgttcctactactgtgcgatgaatccattttgctaacgaaaattgttctttccattgcgcgccaaaacctaggttacatgactttgcttcggtatgcacagcatgtatctttccattattgaatcgtgtgttactacgatgggagaactatgcctttccttttgatgacttcagaaggcgaggcccgccccagtgtacttaagctgactacttcaatggagaataccggcatcaacgtcttggtcaaaattaatacctcactgttatactttatttcccatgagccccctagtatttttaatactatacata

SEQ ID NO: 6994 - DNA, 167 bp, Bacillus thuringiensis
cagctcgtcactcaagatgagacaatcccctatttttaatcccactctctgaccaggcactaactaccgtacttacatagattatctgagtgaagggggtgctgcggattatgtttggaccatcaggacgctgcaagaactcaagggactgttctcatggagaaaca

SEQ ID NO: 6995 - DNA, 312 bp, Bacillus thuringiensis
cgtccataaaaggaggaatatcatatgaaaaggttttgtcagcacgtacaactttccttatacggagcgcttttataaacccattactgaacggaccgatacaagatggtaacggtttgatggttcaaaacgctagggatggagattctgtctagtttagatacttagatgcatctgtaggtggaggaatggaagtctgtgctagctttggacgattggaagagattaaccgaagacgcggactattttgtattgccatgactctattgtgccgagcattcttgtgagccaagaacttaagcaccggacttt

SEQ ID NO: 6996 - DNA, 246 bp, Bacillus thuringiensis
agctgcccttctctgacccgtgtaaagcacagctctatttcccatatgaataccacccacgatagttttggttttttaaacatcactcggggtacaatgcgcactactaacagccctaccatatccatctgctgcctagccccactaaagttagcccgctcacccaagacctcgcgagtcatgcggagaagtactccctctgaacacaccgccactcagtaatactggacctagttcattcaatgc

SEQ ID NO: 6997 - DNA, 252 bp, Bacillus thuringiensis
gctgcttgtatatttaacgcctatgacggataacgagctgcagagcctttcacaattaataccccatttgccacctgatatgggaccttgcgctgctactttttcgacagcggatgtcataactcgcacgctgactaccactgaagagtccgtggcactactagattcgaagatttcctacattcgaacgggaccgctatgccagacgggctctaccgtgcctacatctgacacttgaggcatagatcctat

SEQ ID NO: 6998 - DNA, 318 bp, Bacillus thuringiensis
atgcgagacactctaacttaatggggacgtttgtttttggcataggatgaactccggaggtgtgtgtaaaacaggcaatgaatgcggatggacaaagagcatgtactgatgacatacgggtgagcatgggagcgcaacacgacgtagaagatgaccacatgactgggataacaacctgtgaaccggggctacagccggatgcttataagggcgcgttggatctaaaaggctaggcagcggaggtagtcacctgagtatggtgcgtatgcgcattaactggttggggcgtaaactgtaaaccacggatgggatctgtag

SEQ ID NO: 6999 - DNA, 151 bp, Bacillus thuringiensis
gcacccagctgaagggcgtttcagcactaaccccggtcaccccctcacgcactagaaaagagaccgcggccggaccgcctatcgcacaggtgaacagcctgactcggcataacgcaaaggataagtgccatatgcggattataacgaacgt

SEQ ID NO: 7000 - DNA, 326 bp, Bacillus thuringiensis
cacgattgacattttttggctcgatctttctaacgcaactgatactgactacgtctcaagggactgctggacatcgacctaaatttataggtccatacggaggtcgtactacactctgatcgcatacggattaaacgttcactatcatagaggagaggggattgttgatttcattgtgctcgggttgggtacccggcgcgcaatttattaccgactcatacgacgcacattatgactgactgttttgtacacatcgttcggcgtatggagcgtagatgccgatcttttatcgacacaacccgtacagtgcgggggtattacgtgtc

SEQ ID NO: 7001 - DNA, 272 bp, Bacillus thuringiensis
gccgacagaacagcacaattatcaactggcctttattttgccccgcgaaaacgagcgcaccctttgtgacttgtaaaaaccaacgtctatatacacccccccgacgccagaacaaacgaatgtgtcgaaatccctgcggttacggtctccgactcatttgcacttagcgtcgcaacgagagaaaaccgcacgacggacctgacataaaaacatgcatgagccctagataccttaagagacatgctgacatgactcacacgtgggaattccct

SEQ ID NO: 7002 - DNA, 368 bp, Bacillus thuringiensis
cccccatctttggtttgctggacggctcttcaacagatgtggtacatgtgagccctacctaagcgaaacccgacagcccagaggacaggattagtcgctgactcgttgctatcgaacatgaaaatgatatacgacctaagccaaactagctttgccatgtgcagattgtcgcaagttctagatcccatccaaacgctgatggatgatgccatgtaccgagcttacgctatatatccacagccaaactcttgactaaatcgtgtcaaaacatgtctcgtgtgtgaactcattagcccatcaggagaaccctcgacaaactagcctataccatattgtgactatactgaacagcctaaagagagcccaac

SEQ ID NO: 7003 - DNA, 325 bp, Bacillus thuringiensis
gagacctaaggctagaggctagtttccaggtctatttgcttttgggagattaggcctggaattttctctgccctacttcccttcttccatcagggtagataaccagagtgttatccattggctgcctgtgttgtactttgctgttagagtgcatgctctctctctctctctctctctctctctctctctctctctctctctctctctctctctctccccctccctcttcctcttcctctttctctccctctccctttactttcttctctctttctctcactacatctcccatgttctctacccctatttctcctttcacttttct

SEQ ID NO: 7004 - DNA, 236 bp, Bacillus thuringiensis
tcgacgcagagacggcggctttgttgtttaggatggctagcgcggatctgactgattaaaagagcggatatacctttatttgacagattcagggagcgactccagctcaatcataggagcaaaaggggagaatcagggcaagaaccggtaaaagaggaaagaactatgcgagtcaaaaatgacagctacaacggccactgaccccgcattaaaaggtaactcgatcgcttcaagtg

SEQ ID NO: 7005 - DNA, 230 bp, Bacillus thuringiensis
ggtcccttttttttttgaaaactaagcggcaaaaaatgcacctacagttgttggactgcgtcgatctaccgagcagcactccaaagtgttcgtgcggcctgttcgcttagcgtcaagacagaaagggccagctgaattaccctaaggttcatgggacagaggcatgttatagcgtatattagctcacctctgtgactcagatattcatttggctcatcctaagatacgat

SEQ ID NO: 7006 - DNA, 126 bp, Bacillus thuringiensis
cgagacggtcatttttacaattaggatctatcacatgaaacggtgttatattacacgtgcctggggtaaaggctgcggatgaggatttcaggatatctctcttagcaagactaacatcatgatgct

SEQ ID NO: 7007 - DNA, 346 bp, Bacillus thuringiensis
cggtcgtgatgaacacatctcgtcagggttatcttaaaggcgcttttttttatcagatggcaggcgcgatcagctggcggggtatatttaagacatcggatgctatccccaccccacagtcgacgctgccaagacagaatactggggtgtagcggctggtgcaccccttgtgtacatgcatgttagcttttgtagcacagacagtcgcaagccgagatgactacacatctggcacattatatgtcgtctcactgataacacgccgtgttatatccacataaggccttaaccagtgtgccataaaggaggtgttgcatttacacaatcttttcatactagtgcatat

SEQ ID NO: 7008 - DNA, 121 bp, Bacillus thuringiensis
tggaacggtcatttatacaattaggaccatgcaaatgatccagagttatattacaacttactgtggcactgtcaacgtttacacaaatcaggatatttcttgtagcaagaccaagttcaaa

SEQ ID NO: 7009 - DNA, 336 bp, Bacillus thuringiensis
acacgataccactatggaagatcgtgggctccatttttttttggggtgactcggttgatcagggcgcgggccctctgggtgacctatgaccctactcgcgcttctcggtgtctgcgagtcttccagcactaagtggtgcccctactgggagccccccagctggagctggactgagcatgactactaccgacggccgaacggcaggaggatatgccggctggggcatcatctgtggtgtcccagagtgcagccgggcttttgtgcacattcacctcatatgagtgatttcatgaggcggtgctgcttttatgccgtggttttttactaaggcatgtg

SEQ ID NO: 7010 - DNA, 308 bp, Bacillus thuringiensis
gcgtgagcgattcccctggtgcgggagagagcaaatgggcctttgttgtccgttgctcatatcttgctgcctggtggctttaaatacccacgggttattaagcaacacaccgaggcggatcaacggttacgtagctattcttcgggctggagacaaccgaaagaccgagagggtactgggtagagaagcgcatacaatggatgttggtgatccgtgagtggcgtggcccacttgtaggcagggggagcgagttgcgctgtggtgcaaagtgttcgtaaacagggggaggatggtttacagacatgttc

SEQ ID NO: 7011 - DNA, 313 bp, Bacillus thuringiensis
taggatgccgctcttcataggcactacaagacagtgaatgtacgggttttattggaccacctggttcttgaaactgcgcaaagacaaggactttttctacagtatgccgaatctcatcatatacatgcgacgttagtacatctctcatgcaaaatacgcagaacacgtataccgagtcacggctggaagtgaccatgggataattggagaagggccttctcttacccagatttcacagatcttggtaactgatctataaccatattgatcaggcggttggaacatagcgctacaatttttaccatttaagctt

SEQ ID NO: 7012 - DNA, 142 bp, Bacillus thuringiensis
gcgggcgggatgtcccccaagtaccgccaagtttgaagccttttttccttgctcaggccgtgcccactacaagggagggttttataaacgcggtggctgcttcacgacgccgtgccacggttgagcatgcagtagagggagc

SEQ ID NO: 7013 - DNA, 241 bp, Bacillus thuringiensis
ccctgtgctagggcaaaccgaccgatatgacgactgaatcagggggggtaaaggctccggatttgattggcggacgctggctccgggcctgcgcaccctgtgaaacagtccctggccccacgagggtaaacattgctggaccactgaccgaattgaaagcagcaccctagaaagacggcacgcttacctctgtacggcatattacgaccatagatagtatgaacgccccaagcatggtccc

SEQ ID NO: 7014 - DNA, 215 bp, Bacillus thuringiensis
catgggagacgtttttgcttttagccgacatcaggggacacgtgggtctattgaaacagactgtgcattgcctaccgatatcaggactatcgacgctcttggctggtgtacctaaataaatacgaaggatcatactgcgacctgtataaggtgagatatcaacaggtgataccggtactgtgtacgagttcattcccaaagctataacacgagag

SEQ ID NO: 7015 - DNA, 290 bp, Bacillus thuringiensis
tccctccgccggcatggacgagtaactgattttttttttagacgcattgccggaacgataagcgggcgatacataaggctgagataagataaaagcagcgcacatcaatcgacgcgcccactcgagcaggaatggttacctcaacatgcgcaccaacacgagaggtggattttgtcctgaggcgtgaggacatcgctcaccccctatgatatgataagcggcgcctgatcagtgtgcaccgattacccaagccgcgaattgggaacgggcccatgatatagtgcgccaca

SEQ ID NO: 7016 - DNA, 413 bp, Bacillus thuringiensis
atgggtaccactcaggccatttttcggtaaccaatgcgctttgtttgcaccggcttagccgatgccaactacgagcacgtctcatctcatatcattttataacagtggatgacacggttcagaagctgcagtattgcaaaacaactcacccatcatgagttagataattatactgcttaaacatgagttaatgctttatatggctcggtatgtttatacaagaatccaactaacagatgctagctggatttgttgattcataattagaacgctcttgaagccaatttacaaacgacggatatgaatggtttacagctgatccaccgtatacgctagacatatgccctggggagaaacatacatactggttatatgtgctagaaagatgagatagtaatgctcgtacttgacat

SEQ ID NO: 7017 - DNA, 309 bp, Bacillus thuringiensis
tacgtaatgcctaataccaggctggaatagaagcactctactattacctcaggtagctcgacgaagagtacacgtacaggaaaaactaatgcgctattgaacttctatgaccaactggggagcatggcaactgactgtagctgcagcatggacaacaccctctctatgtggaggtgggaacgggactatcgatgtctgtggtggaaatacagaatacgacacaaccgacgaagtcacaaacgatgagccgataagagcggaagcatccactgttgcttaaagacgaaactatagtgattgggcagcccc

SEQ ID NO: 7018 - DNA, 381 bp, Bacillus thuringiensis
gtgatatattctgctaataacataatctaaaacacgtcatgaataggcagtcaaacatcattaaaggggggtccttttttaattgctgtgggtttaaaaacagcatataatcaaataaccacccacattatacacacacacctaaaaaaaaggcatttcaaatattaaacgccttctatcatttcataaaaccattcaacaccctgaacttttcaacttaatataataacttgcttaactaaagaaattgattacctgcataacgctcttatcacttttcttacaaaatttaacgagtcaacaacctctttcccattaacgaaatataaacttggattattatataaccactaattttgtatattccaaaccattattcct

SEQ ID NO: 7019 - DNA, 307 bp, Bacillus thuringiensis
gtgatataaaatatccactctaacagttttgaggcttattatttatgcagctctatctgatccaagggggggatttttacaaataccttgaattgcaccaccatgatatacagagatagctaatactttaccttctacctatactttatatcctaaagggattactattgggacaatagctatcattctcatgtttgtgatacaaaattaaatcatgacccattgcagtttatacacagccgtcatattgtgccacttaattcgctagggcgagatgtaatatgcatgaactacaactgttaactaa

SEQ ID NO: 7020 - DNA, 313 bp, Bacillus thuringiensis
gaccccgaattggtgatgcaagcggagcacatgcataaagagcgaggcacctttttacaggttttaaacttatctccacctacggtagtcgtatatgaatatagagcgcgtgctccatatgctatgcaacacctgggtatggttctaatgtttcaaaatcggttcaggacaggaagggtagcagagacgaaagaagatacgttaaatacgacgtttgcatgctgaacagactattatacacctgccctgttaattgaggaaaaaatgggaatgtggattacacgatgatacacgcatcttaccagttgtaggt

SEQ ID NO: 7021 - DNA, 161 bp, Bacillus thuringiensis
cgccaccagtattagccccctgcgcaggggcagtgacgcgggcgtcacatatggcagcggacgggattgcaccatattcacctgcgtggcattataagctgtgctaatcctagttgcctgcgggattatccgacagagaatgtctggcgccaagggtcccg

SEQ ID NO: 7022 - DNA, 161 bp, Bacillus thuringiensis
tcaagtaaaagaagagtgtctaaaaaaacggagttaaagctcgatgaatcgacatagatgttcctaagagcgaaccaccaaatgagctcataaataaagccactgaacaacttaggagtcgccctcatatattactgaataacgcagcgtattctacgaac

SEQ ID NO: 7023 - DNA, 190 bp, Bacillus thuringiensis
aatatggaagtgcacgacgaagccgggggattcttagaggcctgtctactgtcaccaccgtgtgaaaagggtcgacaagttattataaaataaggagtaaattacctacattgattaattacgagtagtgaacctagtactaggcgctaaagaagaaaggaattctgcgccatgcgctatctatggaatg

SEQ ID NO: 7024 - DNA, 112 bp, Bacillus thuringiensis
gcaacaattgactcaattctgcctcctacacgcttcatcgagaccagtgacggtgggtaaaatgaaacttctaaacgagagcccgcggaaaagactctgagaaccgcaccag

SEQ ID NO: 7025 - DNA, 136 bp, Bacillus thuringiensis
cataccccgaaaggggatgacgcgcttttttaagcccctgggccgttcacccatccaaccggttgccttcaacagagtggcgagagcaacccgtgagcggcaatattaccataaaatcctcgataaataagtgacc

SEQ ID NO: 7026 - DNA, 603 bp, Bacillus thuringiensis
tttaaaacatcctgaaatcctttgaaactattaacttaaacacctgtataatcttgtactgttttaaattgatttgtgtaatttgctaacggactatgtatatcttttttatacatagttgtttgaacgtttcctttttcaattattttacctatattatcttgtgcaccttgtagcttaccgataatactcgcaaaataaacgtcgattatttgcttattgaaatcttctaaaataacagaagctgtattttctgcctcagctttcaaatccttattcccagttgcatttactttgtagtttaacgttaatttctctggaatctctgaatcaatcgcaactgccttcctagaaaaattatttggaataacaaatatcatattgtaattattatttttcaattcattttccggttcccccggggttactacctaacattttttgttttggatttttatttacattttttaacaaaatggatcttaaaacctttttttattggccctaaaattcacggggctttgatttttattttccatacccacttttatttttgggggtagtatttcatttatttttttaaaattttggtttatggtttat

SEQ ID NO: 7027 - DNA, 434 bp, Bacillus thuringiensis
gctgccaaatcgttggttttttgctgaccacagttcaagtcaatggactttaggtcataatcactctattcaatgtactgattcacttgtaataggagcaggaattggtgctgtaacgattctattaggttgttgctgctataataaactcgatgtgataggggaatggtttatggacagttatattagacgtgactgtgtgacggaaagattaacaggagatattgggctagataatattagtttgtcaggaaaaaaaggcgcctttttagttttgaaggggcatatcggctctggttaaacgaggattgtacgcgctatatcaaggtgaatgcgcttgaatgccggagttgtatatgtagatgatgacatgcttggattacaagagcaattatctgattctatgggaatcttgcttgaatgttcaagattta

SEQ ID NO: 7028 - DNA, 473 bp, Bacillus thuringiensis
gcgcactatctgcccgattatctggacacacatttttttaaaccattacaattgcaatcttctttttacatacatgcaccatgagaagcaaagttgatcacgaatatagctcatataagggcggaaagggaggaagttatgaaaccagtaacttatacgatagtagtggtccgcgatattgagaaggaagggttactagtactagtcaaacctgttcttaattatactgcttctacttatgattaagaggataaggattgataagatggtgaggaaatgcatgaaggtgtgacaggggatatggaagcaaggcctacagtgtagccaggatagtgttcttacttttaggccaaagttgacctagacggtacacattatgctatgacgtggagcgataaatggcatgtgtccatctccgaaacgaaacttggtaaagggatagtacgcgggaaagagcatttgaacataaaggg

SEQ ID NO: 7029 - DNA, 318 bp, Bacillus thuringiensis
gctccggaggggtttttttccaaacctgaggtacacaagggaagcgcagaatttgacatttagcgaatgcatcatacagtgctggacataaaaggtgtggattctgagctgcgtgtgaaagatcaagggaacgaggctcaaactaaataagcgattgttcttgagcaagaacaccatggtttgcgggtgctgcgcgaggagcgagctattgggcagaatgagagggcgtaggtatagaagaatggattcgtgaattatgagaaccaggacaggagtgcccataatgttacgaactaattattaaaagatggtgcaagg

SEQ ID NO: 7030 - DNA, 388 bp, Bacillus thuringiensis
catacatcccaaagcgttccattcattgggccgctcctccagccaccttgcatccatctgataccagagggagtgttgaaaacatactctcacgtgctgccagattaaaaggctcatcatcagtaatagcctaaatcccgcgcttgactttaacttaagaagcactgacgctggctaaatataccccatagcattcgagccatacttgtttggctgcagatctaacgtggaaacagtgtactcattcaatgctaaaggagattagtgccttattgctagctactcaccatggactaagaacaacatactaaagttccgactccatcctccaccccaacgtgttgctaagcccaacccttggctcagtttggcccctttgatgagcata

SEQ ID NO: 7031 - DNA, 345 bp, Bacillus thuringiensis
tagtgctcctgatgtataaatgcaccgcacgttttttgacacacggtgcctaagcctacgtatcgatggggactctagtcatgccggatacgtcaatactgacacagccgagggatatagtattacagatgagacaaacaacctgcacggacgctctttatactgatatgcaatcatgacagatctagcgcgtcagtcaagttcacttgcacctcttgacacaagagatgatgcgggtgtattcaatggagaatgccgtacaggaggcaataacgcctacatagaaagaaagcaattgataggtcatgtcaagaagcacggctggtggagatcattgaaggcagg

SEQ ID NO: 7032 - DNA, 138 bp, Bacillus thuringiensis
ggtacaagccatacgctcgtacttgcgcggccaagttcctttgaaccacacttgcgactgttttaaaggtgcatggtgcagaatgaccgtagcttgcacaaaagacaacaggcgtatcagctagagaagactttatct

SEQ ID NO: 7033 - DNA, 372 bp, Bacillus thuringiensis
caacacaactcaaatactgctggtcctggcgtgttatacacgctcccaatccagatctccacggggggctttttaagaatatgggcggatcccccctcaccacattgaactcgatggtccctcattaacatacggtgtccaaaccgcactttaccatgcaactgcgactcgtacccatactgtattttgacacgctctcgcataatcaccatatccactacgatcaaggtgcacttgtaggatgaagggccctaaatggcataaaggttagctcacaaccttgggaaaggatctcattagcttctccatatctaagtctctactcagcgtggatgtaaagacagagactatgctttacccatacattgttac

SEQ ID NO: 7034 - DNA, 348 bp, Bacillus thuringiensis
atggtggagcatactgcggctgagtagcaccgtttccagaaaggagtactaatcaccctgtcattggaaacggatgctctggtcaccagcgtgctacgaccccacagcctccgtatggcgctgaagcgctaatatgtcgtggatgcatgctgtttacaacatcactgaccttatacaatcaggcgtgcatccctaacgcaggcatttgttgtacgctgcgaatcatccaatgattttgaagcaacgattccttcttgctagagagacggcacctgtgcctgactgttgcgccgcttacgcgcaccattaacatgacggtcatacattggtcgtactaagcatcccata

SEQ ID NO: 7035 - DNA, 357 bp, Bacillus thuringiensis
cgaacaatacactgggcgttgttgtacagccttttttttgggttaaccttgaccaatcccatggggggtttatttcacaactttccggtctaacgaggtggcgggattgttactacccacaaatcgctcgatctcactaacaggggcacattcatatgcgagaatgtacgatggcatgattcataattggtttgaatttaccgtctatcttatttactatatatgcttatgctactactaatacagaagctgttgacatcgttgtttatcgaaataatatgccggggtctggtcgagtgttgttacttcccattacactgactgactatgatataacttgtattccttccacaaaag

SEQ ID NO: 7036 - DNA, 211 bp, Bacillus thuringiensis
tgatctaaagaaaagctcatttgaagtttgcacacattagtattgtttctggcccacagtaagcgctggggctcttttaagttgatggtgttttccaataacaaaaatgctctaccaactctcattgctaattctcacggatgatacactcctgtctataaagcgcatagagatcttcatgacatcttatgagcttaaaatgaatcccttt

SEQ ID NO: 7037 - DNA, 419 bp, Bacillus thuringiensis
cgcctcgcggatgaaacctcttcacacccaatctctttccaactaggaccgagaacgaaatcgtgggggtatcccaagtgatgcttgcactttgccacgacgccgcggagcagtaaatgcggaatcgggtgttatcgagcccatggaccatcgcaccgatgttcgtgaaacccgatcgcccgtcccgagggcacccttcgtgactagaatacacaaccccacgacgttaatgacaaagtttactgcatgagttatagactgaaacgcagacaccggcgccaaaactaggtgtaggattccggccacctgtaacgcaatcttcataaaataaaacggtgtctgcgcagggtctaacaacggacgacctacctgaaaaccgggcagtgactgctgccccaagagcccatgacataccactc

SEQ ID NO: 7038 - DNA, 356 bp, Bacillus thuringiensis
gtcatcgcaggttttgtttctgatcttgatgtacaacttgatcatgtgggttattcgcggatcgcggatcttgtatcgcatctggacacaagctgggcgagattgaaggggtgaaacagctgcaacagatagtcggtgctgctggcatcagataatgtaaaacctcacaactatggaaagaaaaggacgaatgagcagactattgctcggtattgcatacagaactgctgtaattgagaccataggcccggatgatattcctggctagacgacgactcctatcatcgacagagggagacaaaaatggaaaggtgcggttacatatgactacgatgaaagatgtgcttcgcgagggg

SEQ ID NO: 7039 - DNA, 149 bp, Bacillus thuringiensis
cccacaccccccccaccccacccaccgaaggagcacacacacatccccacaccacaacccacaacccaaactaggggcggagctcccacggttgggagagaacccctcggggcgcgaagcgcgtggccgcacacacagacacgcggccc

SEQ ID NO: 7040 - DNA, 174 bp, Bacillus thuringiensis
tatcccctggaatttcttatacagaaagcgctgcatttaaaggtgttatagaacgcgcatcagcagctgggaagcttatttgtcccacaggcggtattattgctgatggtaacaaaacggcacaatcatacattgagcgagggaaccgagcactcgcaattagtgactggaatg

SEQ ID NO: 7041 - DNA, 139 bp, Bacillus thuringiensis
gtgagattccctcggggataggcatgaaaagccgttttttatggaagcccactctaactcgtttctattgtactagtgttagagacttcacttcacacagcaccagttcgcgccgaacgactatcttgcacgatctaaa

SEQ ID NO: 7042 - DNA, 242 bp, Bacillus thuringiensis
gattttcccctgcaatgtatttttccgaagccccaccattaaaagctatgccagagcgttcataagcggcgggagacctgatttgtcccaaaggcgttattattgcataatggtaacaattcgacacaatcatacgattgagcaaggaaaccgctcacttgcatgtggtcactgcaatggaattggcgaagccattttgaactctgtttgatggccaacagctgcagtaagcgcagcggtag

SEQ ID NO: 7043 - DNA, 199 bp, Bacillus thuringiensis
gaaaaaggcacaaggaaagacagcaagaaggatgttatagaagcagggacaagaagggcaaaaaaggggagaaaaaaacaaggacaaaacgaaagagagagcgaaaacccagaagaggaaacaaaaaaagaatgaagacgaaaagacggaggaaacaaagggccagaaccacgagaaagaaaccgaagggaagagggaa

SEQ ID NO: 7044 - DNA, 121 bp, Bacillus thuringiensis
gtgatgtgtggttcactgggcgagagttatcaaccgtcgccgtataatttagcccatactaactgcatgcgagtgtattaaggttagcaacttcacctcaccatgcacaggactgcgccgg

SEQ ID NO: 7045 - DNA, 360 bp, Bacillus thuringiensis
ttcgtgatgtcatggacataatgatgtatggcaacaagacccttagtgatcggggcatattacgcatcggttcaactaagtttgcacgggagggagctgacataagtacagcacattcatatgcaggagagtctactactggaagactatatgttgcttttacagacggtgtagagcgtgaatcgcgccgtgtgctgtaaggaacaaacatgactgatatgtagttgccttcaggacgttccatgatgattttgctgtccaggagaaatgaaaatacggcattacacctgatacgcgacgaggcatatattctgggactggagaacacttataccatgctcgaaggaccgacttaacatg

SEQ ID NO: 7046 - DNA, 223 bp, Bacillus thuringiensis
tatccgctggatttgtttctacagaaagctctgcattcaaaggtattacagaacgcgcatcagctgctggcaacctgatttgtcatacaggcggtgttattgcaactggtaaaaaaacggcacattgatacattgggcaagtggagcgcgcacccgcatgtggtgactgcaatggaattggcgaggccatatgggattctgtttgttggggaccagccgctgt

SEQ ID NO: 7047 - DNA, 163 bp, Bacillus thuringiensis
ttcgtgatgctcggttccctgtttcctggctataaatgaccctttaatatggaagcccacacttactgttctctattataatccggttagaatcgtcacttctaactaaacctgttagagctgaacaattatcaaggaagatataaaaccatttcgctgcata

SEQ ID NO: 7048 - DNA, 177 bp, Bacillus thuringiensis
tatccccgggaatatctttttctgaaagccctcgattcaaagccatgatagccagcttataaaccgccagcaacatcatttgactaacggccggtattatccgggatggaataaatactgcactgtcacccattgaacaaggaatacggacaaccgcaatcagtctctggaatggaa

SEQ ID NO: 7049 - DNA, 165 bp, Bacillus thuringiensis
gtgatgtctgattcgatgcgggattattataaaaggcagcggtgttttttagaccatgcttactgccttctatcgcactcaggttcgcgactacacctctcacagcacatgtatgagctgcgcagacatcaagcgcgatatcaatacggttaattgcaccaaaat

SEQ ID NO: 7050 - DNA, 152 bp, Bacillus thuringiensis
gtatgatcccatcggtgatcattatgaataggcgcgattttagtatgcccatactcactcatttctaccgcaatagggttagagactacaccccgcgcaaaacgcgtttgcgctgaacaactatttggcgagttatgaacacgttgaactgc

SEQ ID NO: 7051 - DNA, 273 bp, Bacillus thuringiensis
gggggctgtattcgcgagtggaccttgcaaccccatgcctattgaaaaaattggcgaaccaaagctagaaaatgaaggggagttttaaccgaactagttccaagtcacacataagtgccggtacagttacgacaacacgaaccgtgggctggtagagagagatgcccttaacatacaggagggcacaatgatcggaagaagaacctaaaccggaagtgctactgggcgagtatacaggtccaccgtccaacgcgggcacgagtggaaacaacg

SEQ ID NO: 7052 - DNA, 191 bp, Bacillus thuringiensis
tttggcccgatatatgtgttgccgaaggtgctccattcatggcattcctggatcgtgtgtaagaggttcgagacctgattggacaccctggcggtgatctagccaatggcatcaatgctgcacattcaaatgttggggcaaggggccgtgcatcagcatgagctctctagaatggaataaaggaagccatt

SEQ ID NO: 7053 - DNA, 303 bp, Bacillus thuringiensis
cggaacggatttgttattggatagagtccagctagtaaacatggtgtacaataggtgctgcgagttgatcaattgaatgcggaacgcaaagccaacttgaaccacgagcacatgtaggatagcaaggccctggacaccctaatataacacaacttatgtctggtgtttaccaaggatgctcagtatttcgcattattctcaagaggtgaatagtttaccactataaataggtaacactctacgattatctctttgctagatgctagcatagctaatgggatcgcattgttacaaaatctagcc

SEQ ID NO: 7054 - DNA, 271 bp, Bacillus thuringiensis
agtcgtgagtcacacgaggagtaaacccgcggcaaacacgctttctgccgcccagcagggagaacaacgtcggaaagaatctatgaatacggaggacgagtaatcagaaacacccggcacaagccacgagagacacctagaacgaacacccacaaggaagccggaccgtacattgatagaatcaagtcagagacacgtacggaccagctgatgcaagacgtaaacataacagcggaaagaacgcccgaatagttcataaagcaacacggca

SEQ ID NO: 7055 - DNA, 269 bp, Bacillus thuringiensis
ttcccatactggtagcgggatctttgctgatatggatgtgtaccgaaacgcattatctgacacagtataaagcactcgatgaatacgagcctcaggagtattgacaagcacctctgaacatacatcagaggaaaaatgaattgcctttagtctaaacgagatccaatgcgcatgtaatccgcgttcacactatttggataaaaccctaggacgatcccttaacggtatggggccaacttccttttgggcttaggctcactggggatgac

SEQ ID NO: 7056 - DNA, 323 bp, Bacillus thuringiensis
gagcgttaagccttctctcttggctcctaaccagggccaaatagagggagtctaaacaatcggcccggatcaacggtgctgatgacaaataacgcgataaggaccctgttacttttcatactgcaagagggcttcccatatgtataccctctcgtctgttgccagtacatacgagtagctggtttagttttgctgaaatacatgatgcgacagccgaactatagtaaaggtatgttttgtacgatcatcatgagcacaaatctgttctccctcctgtgaacaccatgcgcttccacaagtcattgtatagatccccactgaca

SEQ ID NO: 7057 - DNA, 273 bp, Bacillus thuringiensis
tcgtcacattttcctcctcttgggaattatcaacaggcacgagggagaagtaaccgagggaaccacacattggtattaataaaaatcggtattcgtgtttcatccattgcaggtggtgaatttttacgtgaaaccagacatctgggtaccattcgcaccgtatggtttaagcggagttttagtggggggagcaggagtattctgtgctttcataggattcgatgcactagcaactatgtgctgaagacagaaaaaattcgcaacgtgatctac

SEQ ID NO: 7058 - DNA, 432 bp, Bacillus thuringiensis
aggctaggaatccaaatcagatacgaagtgttttcttttaggcagcggagacagcacgaacaccaggcacctaaagctgcagcagtgccgcttgcaacttcaaacgactcttgtgcacctgcttccgcatacgcccggtggccatgcgatggctaagctaagcgtggacgtgcgggggccggaccaaggcaggagtgcaccagcgtgcgatttgacctggcaagaactagcgcctcaggaacacagggggtaaacccggccccccaaagcacgcccaatggaaactgcaccttccttcaagcagtgcatgagtcgcttgacagcacaagggtgtcgatctggccattggaggggagctcttatttggcgggggatagttccagggagcccctagttcatatgcaactcccaggacgatgcaccattctgact

SEQ ID NO: 7059 - DNA, 294 bp, Bacillus thuringiensis
aatccaaatcagataaatcacgtttctctcattttaaagggcagaggcacacgagtaaggactcgttgaaaaattgcacgatgttcttgtaaagaagagcacactcgtaagatcatacacctcgatgggagtgaagtgatagtcatcgattcagttattgcataatgcacgcttgaatgatgacccttcttttaagagcattatatctgtgacatgtgataccacactcatagtcgtgtgcaccctcttttacgccgacactgaaactgtttaacgcacgaagctggccttaga

SEQ ID NO: 7060 - DNA, 394 bp, Bacillus thuringiensis
ccttggctggtttttttttatgtttgcttgaatataatcatgcatgtctaggcacgagacgttgaaaggagaagatttagttgtccaaaagtgtggggatagggttttgttgaaaattcagagtgctgtatcagtcggaattgggatttaaagagctatactaagatgatgcactataatcaggcgttgtattttgagtgaatagatggatttgtgtgatagtgaaagcttaaaatgctgtaaaggttatgtacgaggaggaggctcaggatggacttttaaggatacttagacatttaaacttgttggtagaaaacgttatcgaaggtacagaccatgatgtttaggggtattccgaacagcttacgagttattctaagtataaagggaatgt

SEQ ID NO: 7061 - DNA, 160 bp, Bacillus thuringiensis
tatcggctggatttgttttaagagaaagcgctgactttaaggctgttccagtgcgtacgtcagcagcgggagacctcatttgacacaagggcgttactattgctgatcgtaacaatatggcacaacgctcgattgagcatgggagccacacaccagcaat

SEQ ID NO: 7062 - DNA, 176 bp, Bacillus thuringiensis
ttcgtgatgtgagttttcctgcttaatggttatgaagagccttctgttatgggagcccactctagctgtattctagtgtattcatgtaagagacgtgacttcactatgcacatggatgagccgaacgattatcaagcactatgtaaaaacggctggctgcactagagtctcttaat

SEQ ID NO: 7063 - DNA, 329 bp, Bacillus thuringiensis
cttcaggccccgcttgttttaccagctgcccctatgccggaaaggcgggatggaatggaattggccggggactcgcatggagtaggtctagtgccttaaattgctggaagctcaaacaatgtccttgtgcaaaatgataatcataagagtgaaccgagaaagtcccatccaccaggatatattaccaggggcacaggcccgaatgctaatgcgagctgctgtccaaattcacacagctcacacagcgaaggcattaggagtaaatcactcactgcttccacacatagagctaaaacggcattcagtccgagctaagctttatcctttat

SEQ ID NO: 7064 - DNA, 113 bp, Bacillus thuringiensis
gctgcctgttttctcttcttacaacacgattcaagccatctaggaggggaaggccagccccatcgggttcttctgttattgaagcaacaccagctacagtggcagatgctggg

SEQ ID NO: 7065 - DNA, 295 bp, Bacillus thuringiensis
agacgcgtcgatccaacccggatgcattcaactcaggacctaactgaacatttcattgccgcaaataagcccgctacgaagaggggggccattactaacacctcctctatagaaaacaagatatctcttatatcacagtgtcagaaaaccacatatcaaagccaaggaattagagtatagttacaaaaatcggcaccttttcatggaagaagaagagatgcaactctacccttttcctacgcctctgccagcgaataacgcacatgaatagcgaaaaatgacacctctatgccca

SEQ ID NO: 7066 - DNA, 342 bp, Bacillus thuringiensis
ttgtgaatatgctaaaaataaacgggaacactttttttttcgaacgagcatttgacacgcgacaaatagttgttccaggtaaacttgttataacaaccggaattgacggctctgggttaacaattccaacaaattgaggtccgaatgcatgattacgataaatagatgctggaactggaataagtctattagtacacgggtcatacatgcgttgcttaaaaattaaactggacatgatttatcaagataggatgcgttctctatactatacaacacctgatgtttaaacggttatatctaatacataccagcagagaaaaggttactacgtgagatggaaaa

SEQ ID NO: 7067 - DNA, 154 bp, Bacillus thuringiensis
cggtcggacatttttttgtaccggctaacgtaatgagcccgtcaaccctcatgaggagtcaagtaacaattagacccctcttcctcttactaaggaacttactctgtcgacttaagacttctgtctggacgggcattatgcgcattaatgaagc

SEQ ID NO: 7068 - DNA, 319 bp, Bacillus thuringiensis
gcgggcggatggacctacatagctaccctttttgctttcaggctgggttagtgctgaaacatacgtgtcatgtgcgctattaggacaggggcccaataggaacaaggggggccgtttgcacgtcctaccccataagaattatctcctccactggctgtcatggaactctggacgaacgaaggagctgacatctgttagataggtgccaccctggttgagcatgacccaccgtcataccgacataactcgtatcggattttgacagctacactatcatgattaggattgctctagacaacacgactggtagtccgattca

SEQ ID NO: 7069 - DNA, 184 bp, Bacillus thuringiensis
catgtggccggatttcttttttttcagagatcccgccgtgccaagaggcgcttttttcgacttctcaattgcgtgttttgaacaaattcatgtgaccatggaagagcttgccttgatcacatgtgacaagaacattactcgggtgaacggcgtgattgtttgtgggtcctactaccttgtaagc

SEQ ID NO: 7070 - DNA, 146 bp, Bacillus thuringiensis
gagcgttgtgtcagatagataaacgcatcttgtctctggccggtcggttgggacggctgtctggtgtctgaactaggaagttgtttcggcgcttgtgcagtatcagtagcacagacctcgaagacttctagaagaggaacactcga

SEQ ID NO: 7071 - DNA, 145 bp, Bacillus thuringiensis
gttgtcaagatgctttatatggcactggttgggcaagctgagctccgccaccccaattgactaattgcctgaaatacatgtcatataggtctttatcgatccaacaggaaccccaattaatgctttagttgcctagaaaaaagac

SEQ ID NO: 7072 - DNA, 199 bp, Bacillus thuringiensis
gcgttatgatacggagccagcatgcgcgatcgcgagcattaactgttagtgacggacataaacgagacattttttttcacagtcgcggagcgaactctccacatggatggatgacatattacgaagcctatggaactaacatagactaattaccacagaagctccagcactatctctactggctacagccgaaagcagt

SEQ ID NO: 7073 - DNA, 325 bp, Bacillus thuringiensis
cgagagcatattggtcatgtggctcggacactaacgggagaacttttttcacagtttctagacgtagcgaccatctgcgtcgatggtttagtgcacggactagacattgaatgtagccactctttgagtaaagccacagctttgtcaattccaaccattgcccatagcggtccctgctttaaaatgcgggaggacgacataggatcactcattgatctatagcagggttccattaacacatatgcgttattcacgaagcaagcgccgcagcattctatctatattacagttgattactcagggaggggtgtgccaggataagaca

SEQ ID NO: 7074 - DNA, 103 bp, Bacillus thuringiensis
gggggtgaagatggtcgacgactaaagaacataggcgagttgtctgaagcgacatcactcatggatatggcaggagggcataattctctcactgtggtgccat

SEQ ID NO: 7075 - DNA, 364 bp, Bacillus thuringiensis
gcgaggtgatggttatgcatatctaaaccggcagcttttttctaccgataatattttaaccgacgtgtgagtgtacgttaaaccgaattgtgcgcataaagtacaagttaggccctatgcaccacgaatgcgatagccattgtgacatacagagactttgtacgaccatcctgcaatgcacggagctgacatatgatagcaaactgtgaccttcgttgaaagtaacctacccgcatgtggacataggtagacgtggattatcccatatgcaccatcatcatgagaagggcccccattagcgccacgtacattacgattcatggaacggaagctcgcagtagacctcaccacacttggatagaaa

SEQ ID NO: 7076 - DNA, 396 bp, Bacillus thuringiensis
cgagagcgccgcattttcctaatagaaccgagagcttatctgtacccagaggcttatgactgacaccagttgtacgttacacttgactgtgcgccctcagtacagtggcaggttgttttactactgatgctcttggtattgggacattatgtcactgcgccgttacaggctgctcggcacggagttggcttgtgaaagctacctgtggccagcttgcataatagcttacctgcacatggacaacagtatatggggcgtgcactacatgcactgtcggaagacttgttgccacaccgagcacatctgacaatacaacatatccacccattgcaccttgtatttccacagacacttcgacagcaataacaggtgactctacgccaactactgctagta

SEQ ID NO: 7077 - DNA, 191 bp, Bacillus thuringiensis
tggtgctatcttatgagcagccgcccaacattgagcatccctcagcccggtggtcggggaaaggggcaagtagcctgaaaggagtagctaaattaccagctacttggccgtggtagagcccttgttggctatcgtattactgccctgcgggtacccggatacctggcccgcattcagcgtgagtgaaggaa

SEQ ID NO: 7078 - DNA, 395 bp, Bacillus thuringiensis
tggtgatatttttttagcacacgccatacattgatcatccaacaccccgggggaggcggcatgaggcttgtagcctgataaaagtactaaattaccaactacttgccctagttagagtacgctgttggcaatcggcagtcatgtcctcagggtgcggggatacagggctcgcattcaccgtgagataatgaaggatagaacatggtagctaacaagtgagcaataggcctgcagccattagtaagaccgctccagctgcagctgtgacatctgtaacgccgcactggcgagcaggagggaaattaccgctaaacaaataggtggcggcacaccgcgtgagtatggtcatgccaaccctgtgtccctggaaggtgcacagtgctctcacctcgtga

SEQ ID NO: 7079 - DNA, 133 bp, Bacillus thuringiensis
cagccgtattttttgtagcgcctccttacattactcatccgtcagcccttagaacgggtgatgatgcaatcagtctgtatagtgttgaacatgatgacttactaacgggagttgatgctcctcttggagcacg

SEQ ID NO: 7080 - DNA, 387 bp, Bacillus thuringiensis
ctgcgacgtccgtcactctttatcaatgccttttgttgcgctgggtgttcaaaagctttaccgaggagtgatgcaccgtacactcggcattctgcgtagtgtaggggtcatactaaaagaagttcgaacgcagaagggactattacataagctgtcgtggttttgtcagacgccacatgagaaagcacggaaaatttacatttccggttcctgttgtgaaatgttacttacgtattggcagcagcacctacacagtgcttgttcagcaccatctgcgttcaaggcgatagatatgaatgcacggtctttgatatcaatgaatgaagcgagcccagatactagatctacacgaacaagaaagctaaagacccgacgccttaaatgatc

SEQ ID NO: 7081 - DNA, 323 bp, Bacillus thuringiensis
cgacgcgtttcgtatccagtccaggagacgtgatgcgtccgccttacaaaaaattaccgtccggttttttgaggcttgagcggttcccctgactgctggtgcacagggatctatatcaaggcgactatgtaacccttgcaccactaaagcacgtgctttggaagcttatagtgcagtagccgtcttttaataatcatccgagacagcgtgtttgggaacaactgaatgatcttctgctttccccgaaaaaaacagcctaccctggagttgtgaagggacctgctctacaccaactcacaagtaggccaaggcttaattgcacc

SEQ ID NO: 7082 - DNA, 319 bp, Bacillus thuringiensis
cagctgtgccactttttcatgtctaaaccgtgagtttttttttaccgacagggttttcacttacgggtgatttacgttacacttgactgttcccatacagaacaagttaaggtccttgcgctacggatgcgctgggcactgggacataaagccacttcgtaagatcagcctacactgcacggagctggcttctgatagaaacctgtggcctgcgtttaaattaacctacccgcatgtggacaatagtagacgtggcttcttctgcatgcccgtgcataagaacagtggccacctatagaacttcttgcattgcgaatta

SEQ ID NO: 7083 - DNA, 268 bp, Bacillus thuringiensis
catatcgcgcaaactctttttgacgcccgaggagcaatgacatgtccaaggcacttatagaggctgtcaggctactggacgctcttccactttctcgatcacacactcaccaacctgataatgtgggctgatgcgagcacgcccatctgactcaggggggagaatacagcatggcacagaaccatgggatccactagccaaggccatttcagcacatagacatcgatacgcgcaaaaccgttacatggccgtgaagatggcgcccctt

SEQ ID NO: 7084 - DNA, 170 bp, Bacillus thuringiensis
cgagagcatatatgcatgtggcacggacactaacgggagaactcttttcacacttgctggacgttcggacaatctgggtagatggtatagtgaccagcctatacattgaacgaagccactcttccactaaacgcacagctttgtcaattccaaccaatgcccaaaacagt

SEQ ID NO: 7085 - DNA, 152 bp, Bacillus thuringiensis
catcgggccaacgttatttgcccgctcccaaaaagaatcgcccggggcgctttatgaggcggattgcgaacggtccactcttccgctcccatagataactgcctcaccgcgtttagcgggtctggtgctgaaacccttatccgcacaaaaag

SEQ ID NO: 7086 - DNA, 266 bp, Bacillus thuringiensis
gcgcgctgattgatatacatttcaacgctttcatttgcgccgagcggccactagcttaaccgacgtgtaatgtaccgtacactgagctgtccgcataacgtggaagtagggctacatacacctcgtattccaaaggcatggttatcatacgctgtctttgttcggccagacgccacagcacggagctgacatatgatattgtactgttcccgtcgtggaatttgacccacatactggttgacatagatggtcaggcattcatacgc

SEQ ID NO: 7087 - DNA, 269 bp, Bacillus thuringiensis
gcgcggtgattgttatacatgacagagcttttagttttgcggagcgtctaatggcttaaccgacatgtaatgtccgcgacaactaactgtccccataacgtacaaggtctgcttgttacacctcctatgggaaagggatccggacagttaatgactttgaacagacagtggcaaaggacggagctgacataacatataaacctgagaccttcgtgaatattgacctacatatgggttgacatatgtagtcaggtatttataagcatgca

SEQ ID NO: 7088 - DNA, 410 bp, Bacillus thuringiensis
aggctaacttactttaactaataggtgtgtcgcacaaagttgagctgcgtattacatatcgagggtctattcacatttgatactgagtaaaagagtaaaaacgctgaatcaacatgatgacaaaattgtcttaatataggtacagctcgcaaagaaggccacatttgctgtatagacacacaggctcttctatctagcatacatgacactacatagttcattggtcctaacatagtccgatctactggtactgcgatattccattcagccttgtttaccgagcaatactacttggtctcctacttggactgtgatggttaccgaaacattcaacatttactgatctatacaaacacgggcactaacagatacttcaaccctgattattaacgcatagcctttattagata

SEQ ID NO: 7089 - DNA, 490 bp, Bacillus thuringiensis
aagacgaatccacaacacaaatttgagctaatcaaaaaccgaagccaggagaagaaaaagatatttttaatacagggaaaaccacggccaaagaaggaaaacaggcagaggttaaaaacgaggatgaaattccgtctggggcagagtatgagaaaggaaaactagaagcagaaggggagaagccggccccagcagagctgaaagaagaagctggaaaggcgagggcgaaggatgaaaacatgactgagacgaaagagagaagcattaacttcaaagtgaaggagaaagaatccgttgaagaggacaaggcaattgaaagaaaagcaattgttgaagaaacaaaaaagtcaccggagcgaggagagattgatattacacacgaacagaaaggtggttaagtgaaagctcataagagggtgaagaaaaaagagccgaagctaggagaagaagtagagtagcagagtagctctaaaaagacggaggaaaacgg

SEQ ID NO: 7090 - DNA, 323 bp, Bacillus thuringiensis
tgctaactggtactacaatggccaaggcgattgcattttttcttgcacggaatcaaccaacagatcaagaagaaaagatggaactctaactgccgtaactgatgcatcacagcaatagcactatatacagtcttttatgaatttcaataacaagcccttgcgatgggaattccaataacgacccgtaagaaaagcgatgcggaacgatgatacccacaggtacaaaaagaggacaggcttggtccactggacttagaaacctagcagccagatatacggaggttttcaaaacatggctccttattggagggcacataggagga

SEQ ID NO: 7091 - DNA, 349 bp, Bacillus thuringiensis
agagaccttttgtttcagcgactggaaggctatcaaatcagtgcgatactttcggcactgtctacaggccgataaataaataaccgacgaccggtattacacttagaaaggcttatgtgagcccatgaatggctgggtgacttaaccctaaatgtatccagccaatgcgcattactactagaatagcgagactcatcgatgcaatggctgaatccgaagaacgtgcttgaaatagaagaaagccttctctacggatacgattggatgcagagccacaagaatggctgaactagcgcctgtatgatgcatacatggatcgctccagtaccaaaatatactggccatacag

SEQ ID NO: 7092 - DNA, 121 bp, Bacillus thuringiensis
ctagtaatgcgtccgatgcgggccgaagttgtctaatgcgcaccaccaagcatggcctatggggagaggtgtttaacctacccgaaagtacgttcagaattgggggctgcgagacatagag

SEQ ID NO: 7093 - DNA, 403 bp, Bacillus thuringiensis
gacgaataggctgcatttttacaatctgcatagctttcattttaatcttccgttgatgagggcgagagatggtccagtatgggaacaagtgcattgctgtccatgatcgtgtagtttaactaacatctactaataccaattcatcagcgacacgtcggattatcattgagtatgccctactacagcctacagctgctgatgctactaatactacacgattgatacctcttttgatagtcattgaccctctgtattgctgacatatgattgtgtatgattgtttaagtgattaatcaaaagcctaatttgatgggcgcaaactgctatacattcatattgttccacctattattgcgaattacttcacaaattatgaccgattcgtgaacggtttcacatagag

SEQ ID NO: 7094 - DNA, 139 bp, Bacillus thuringiensis
gtttcgtttcgtatccagtccaggagatgcgatattctcctttcgcccgctgggcgtctcgcttttttgttccgttccgtacggccttcccgacggtggggcttgcttaactgctgatggaatgcgatgcgaagatctt

SEQ ID NO: 7095 - DNA, 153 bp, Bacillus thuringiensis
tgtggagcaaacctagcctaggcacgcgaggctaggaatccaaatcagaggcaaccgtttaattgcagctcaatccgcctacatacacgtatgagagttgaccacaagctgaaccgagagcgccagcagttgatagatcgcccagcggagcac

SEQ ID NO: 7096 - DNA, 286 bp, Bacillus thuringiensis
ctaattatgaagtttgtgtgtggcgggcgagtaccacggggggtacacgacctaagactgggaaacttcaggataacgggggttatatcgggtcatatgatggactgcatggatcgaaattgagaggcggctcacgctggcactgatggatggaccccagttgcattagctagttggagaggtatcacacgaccaagggaaccatgagttgccggcctgagagggtgaacggccacactgggtctgtgacccgggccagagttctatggcaggaagaagtggggaa

SEQ ID NO: 7097 - DNA, 286 bp, Bacillus thuringiensis
cccgagatcgagaaacaccgctcgctatttgaatctgtgataaaaacttaattttcttccctgcctcaaatacttattgagattctagaacttttcaggaagatactatgcggcgctcattaaaagtctcctggaacaccttcaagagacataacaccgtaggaggctatcattaactgatcgctcgcaacaatgacaccacgagtggctctgcccatattcggcgagacatatgagcatccccttcttgaactgctttataacagatgtgatttcatgcattata

SEQ ID NO: 7098 - DNA, 250 bp, Bacillus thuringiensis
caacggcttttcttgtattgacgataataacaaaagcacgcagtttctactggaatcagatatacaagcagaacaacaagggacgcgagctcaccgttaagagcacaatctacgtgcccgacagaatcttgaccttctacggtgcctgtactacactgatatcagatgaggaggactccatgattacctacgcgtggctataagcgtaaagccattggtgaacaaggttggagggaacatgaatttgctg

SEQ ID NO: 7099 - DNA, 278 bp, Bacillus thuringiensis
cagcagtcaacacttttattgtctacacaggtcggatgaacgggatcagggttttgttgggcgagtgatggctgatgacctctacggggcaacttaagaccaacgtcgggaatcagatggctcataaaagagggcgtcatataaaagggttacataatatacaacgttgagtgctgcattactttatgactgcgatgatttgataatagccgactactatatttcaacatggacggcggtatgttgaccatttttaaaaccggcctctagaattcttt

SEQ ID NO: 7100 - DNA, 195 bp, Bacillus thuringiensis
acacaaaagacctcccggaccccaacagagagggcaacggacgtgaaaatagaatgcagggggatcaaggactctaatctgcgccagacatcatggcggaagcagcgacatgggtaacgcaccgggatgtggctcgggcattcgtgggagcgaatcccaccagacgccccatttttctagagaaagaaataggcg

SEQ ID NO: 7101 - DNA, 101 bp, Bacillus thuringiensis
ccgcttcacatatttatctgattggatgaccaaccaaaggcggactagtctgctatgtatatccagagccctgacacacacgcttggcgacgagcttactg

SEQ ID NO: 7102 - DNA, 381 bp, Bacillus thuringiensis
cgacggggcatggtggctaggcttgggagcgatggcttgctttctaaacggcggatgctagtgagggcacattctattaggccaaacagctgcacatacttatccacttcatacacactgtgagaccgtaactggcggtctgaactgtggctcttgtgactacggatactgtcacaggcaatcagactagctctgatacttacaaggcatctggagaacgactgctttatgttatctgagcaggaccgctaggccagtcggtgctaccacttgcagacttttacacttagaggtaggcataaaggtatgtccgtgagagccgactgtcgacaggtacgattggaatatgttcaatgcccacagcttaggatctatctttac

SEQ ID NO: 7103 - DNA, 458 bp, Bacillus thuringiensis
aacgtggactattttttccgagtgcaacagccctgaaatgacgtggattgcatatatcaattactgttattaacaaactggactctgtcacgatgtgaaatgctatcgcagttgagttatatcatagtggacaatctcaacaaatataagtggcggacagtgtgtagtctcgacactgacacaaggaggtgacgcgtagctattacaatgacggtgttcttgtgatggagaaacccctttaatggctgggagaaagataaatctcgtagaaccgtccctccaccgagatgtggtatataccattccgactgttttggtacgagatgtgatgctgcattttggattccggaaatgtcatctgaaattacaacaccatgttgtggtaaaggatctatcagactagcaagttctttcttgcaaatagatgagggtttaaacatcggcgctatactttggcc

SEQ ID NO: 7104 - DNA, 468 bp, Bacillus thuringiensis
ggagagctatttttatgtggatcggaccctcacgggagtgcttttttcacagtttctagacgaagcgaccatctgcggcgatggttaattgcacggactatacaacgaatgtagccgccccttgagtgacgccacagccgtgacaactaccgccatagcccattgcagtccctgctttctaatggtgggaggacactatggaacactcatgtgtttaagcggattccatcaactataggctataccgatgcaatggcgcaacaactttttatattacagtgattactgggaggggttgacaggtaagacaggagatttcatatttttcgttaagagcgacgagattgagcgccgctttaatgccttacgtcgacagagtactcgccttttatataataaggattccttgtattcaagtgtaaaggaccggccggaggtgttgagagctgtggctcatggtctttctct

SEQ ID NO: 7105 - DNA, 328 bp, Bacillus thuringiensis
ccacgagatctgagggacatggttgctcggctagtcagcaaaggttttctttttaaacggagactgctacttagcgcagatccttattaggccaaaaaacaccacatccttattcacttcatacacactgtgggagccaaccaggcggcctaaagtgtggcccttgtgaatacggatactgtcacacgcaattagactaccatcgctaattacaaggcaaccgcagaacgactgcattattctaatccgaacaggactcctaggccaatcagtgctatcacttgcagacctttacactaaaaggttcgcctaaaggtatgttcggcaa

SEQ ID NO: 7106 - DNA, 186 bp, Bacillus thuringiensis
caagatcgttatttagaacgccgaatccctagatactaacagagaccgatttcacacctggtaacaggggtcagcaaccaacatataaatttataagtacaagcagtgacatactggcgtgaaaaagaactgagcacgtagccagtctgaaaatctaatgaagctatggatattgtgggcctagat

SEQ ID NO: 7107 - DNA, 511 bp, Bacillus thuringiensis
cgtgatccttgatattcatagaacaatttgtatttttcgtttttttaaaagaattgtaaaataccggaataaggcaagaccaaatatgggcgcgggatgtgaagaaagatatgatttgcaatttttgaaatggatatggaaatatcctaatgctaaacgacctacaattttaaacgggttagagcaattgtccgatgagaaaaaggctattggtttaaaatctccaaatgaggttcggaaatttttagagcacatataataatacaatgtgacacaacaattctttttggatcttaccgattagattaattaaactaatcgtttattattatgaaaaatttaacgctttttgaaaatcgtattccgtaatgagaatatgactataaattcatataaaatgaacgtttggaggaatagaaaatgactaatgatttaatttaaacaattgatacattgatggttaatatttcagctggagaggtagtcttaagagatgtatccataaaaaaag

SEQ ID NO: 7108 - DNA, 428 bp, Bacillus thuringiensis
actgccatgttctttggcgagcgtaagacaggaaaaccgaggatacacataggctgagtggaatacggcgatcacgaaagttacggcagattgagtgaacacaagatggacttggctgaaccacatacctatcatggagaaaatagatggtatacgcaaactctgaaagcgccaacaaactatgttgtcgaacaccacgcactgactattacagaccgctctggaaatgctgacatgagacaggggacaagaatgcgcgtgaggcgatgatacactggacagtgggaattacgcagttacgtatatttgggatcgcgcggccgcataggcgaagttgggatccagacggtaaacggactcgctcttggcggcaataataacaatttatgttcaaggctagaagcacaaacgtttggaaaaagtgctga

SEQ ID NO: 7109 - DNA, 110 bp, Bacillus thuringiensis
tccggtcgttcaatctgtcgagccggatggattaaggggctgtaccaacggtcgcaccgaggccatttgaggatagtgcgatgttccggttggctgctcactgactcagt

SEQ ID NO: 7110 - DNA, 257 bp, Bacillus thuringiensis
tacgtcaagacatttaatctgatggagcgaaacagagacgcggcgggagatttctcctatgtttggatgcgttagccactgcatatgatgcgtcgatacatactgaacaaggatgatgccggaaaaattactgcgcacagagccggtgtcagaattgtaacgatgatacgctcaaggagcggaacgaagggagattaagatacgatggcggagggtaaaaaactgtaccacacaaacgccctgtgaaaggggtacaa

SEQ ID NO: 7111 - DNA, 310 bp, Bacillus thuringiensis
  unsure (1)...(310): unsure at all n locations
tttcgtctgctttacaatacaaanagaattctggggccagaagttttttattttgtgttcacctatctcaccgacaaagagataaaccgtgttaatacgatgtctcaattcttcaacaaattgcaaatttactttcgattggacgcgattataatacatcatataaaaaattacgtatgttagatgtggagttgattatgtcgctaattgaagggcatcaactgaagagagaatctctggggtatgaactaacataacacctttaggaattggtgaaggattctgatagaagtgaacacaaatttcctaa

SEQ ID NO: 7112 - DNA, 122 bp, Bacillus thuringiensis
gacttcaatgtctttagattattccactaccgctgataccctaggaatgattccaaagctgcactggggtaattaggccgggcccactgactgtgcagagacgctccactagtgagctttca

SEQ ID NO: 7113 - DNA, 127 bp, Bacillus thuringiensis
tcgtgatctaatgaccttctaacttacgaattaaaaccgaatcatttgacacatatccccagggagctgaggggggtgtcaagcaacgcgagccccggccacctcaacaacagacgagggggggccc

SEQ ID NO: 7114 - DNA, 204 bp, Bacillus thuringiensis
tttttatatgctactgtaacaaatttttatagatctttgcttgcagtgatgactctaaatggactcaggttccactctactctgtactccctttgctgatatttcttcattctggaaaaacatgcatcttggtacatgcacatacgtaatatattccattcctccattcaaaagactcatacacaaatatattgcaggcttcaa

SEQ ID NO: 7115 - DNA, 398 bp, Bacillus thuringiensis
ctacagcatcatgtatgtgagtcgtaatcgcacgatataatttttttaacatttgttgggagttagcacattctgggaatatgtcataattacaagactatagattttagatagccacaatatcatttgtggcaccgttttgtaactttcgaataatgactaaaacagtttcaactctagaattcgtgtcgacgctcagttctacaccatgatctagatgaaagtaaattatctatagggttatcacatgctaatgcagcatctggttgaaatattagcgttatgatgccgaggttttcagagctaagagctgaacttccctattgttctctaactgcgttggcaacgacagctgatcctataccgtgtcttgcataatgcgagggttaaatactctt

SEQ ID NO: 7116 - DNA, 150 bp, Bacillus thuringiensis
tatgactttcgttattccgatcggaactgacgccgacagcggggttaatataagtgccccggcagtattccccgaaaaccgaatacgaaaacctaaagaatctgcataatcggctgacctgcaaacaagaaacatctctaaattaattaa

SEQ ID NO: 7117 - DNA, 398 bp, Bacillus thuringiensis
cgcaccaatccttacggtctgactacactgttttgagttcgctacactaccactgcaaccattggtgtcaagccatcatataccagtggtgatgttagccgccatgcattgccaaagcagcaggactacgatcgagagactgtccgcactcttcagatggcggttgctcccttgccaacatgataataagatcagctaacatgcatggtatttcagttactacacacttcattacctcttctgccatgtctggcatggcaacggatagaccacgggtctgatgacttgcatcttgactactacggataagtcattgaaagcgctcattagacacaattgtgacctacaccgaggacccatagtccatatagtgcatctagagtctgagacttctacac

SEQ ID NO: 7118 - DNA, 210 bp, Bacillus thuringiensis
cagcaatgtcctgagcactcttcaaagcttttattttcgctacaaagacacttgcttaaccgaggggtaatgtaccatacactatgctctccgcaccttgtagctatagaccttcaaaaactaactcttctaaaggtacctacttcataagctgccctgggtctatcagtcgccccatcatgaagcgggtaaaagtaatccttccgctac

SEQ ID NO: 7119 - DNA, 179 bp, Bacillus thuringiensis
cgagagcaactttcatgtggcacggacactaacgggagaatctctttcacagtttctggacgttccgaccatctgggtcgatggtttagtgcacagtctagacatcgaatgtagccactctttcagtaaattcactgcttctgaaattccaaccaatgtccaaagcggtcccttcttta

SEQ ID NO: 7120 - DNA, 327 bp, Bacillus thuringiensis
atgaagcgccgccatttcctaatgctacggacagcctttgttttcacattacctttacaccgacatcggttggagatttaaatagactgtgcgcacacactagcttttaaagtgcaataatatgtgcctcacggcgtcctggtacacaatccccttgggccaaaaaataatattcaacagcacgttcgatttgacaacgttctacttggtagctcgtagacttatggccatcctattggaaaacatagtacgcacgctgatctccatctattttaggatgatttaccgctacagagagtacctcttggaaggcatcattttgagcca

SEQ ID NO: 7121 - DNA, 373 bp, Bacillus thuringiensis
cgtgattccacgagtccttacggtctgactacaccgcctttatatctctaccctaccactgctaccaaaggtgtcgatgcgcatattgggtcgcgatatgagcccccgttcatagatggaacagagtcactccactagtgagctttttcgcaaagttcctagtgaagattgatcataagccagcatcccatttgccggagcaacaacacagggtggtacgattaatacacacttcttgacctatatctggaattacggaatcggcccctgttgactacggatggaatcactcggagtgggactactaatgatacaccattggacaaggggagggtgactgcatacggcattgcaatgaggacccctagtccaa

SEQ ID NO: 7122 - DNA, 353 bp, Bacillus thuringiensis
taccactgataccattggactgaatccgcagctcatgtggagtagtgagcccaggcacagttcaggcgcagagtcactcgactcgggaggtattgcgcaatctttaaatggaggatgattttatggcaacatgacagctgattaagcaaactccacacacttttccacttaatacacactacgggaccttacctgtgctggcagggctgacttgcttttgactacagacctgatcactcacagtctgtctgccatggaaggataattgacttcagttgtttagactgaactgggttattcgttgaggaccctacagctaatccaatgcttttaccttcaagacttttacactc

SEQ ID NO: 7123 - DNA, 349 bp, Bacillus thuringiensis
cgagagcaataggcatgtgggtcggacactaacgggagaatttttttcacagttgctgggagcacgcaccttctgggtagatgacatactgccatgactagagaactaagatagccaaagtttcattggaggcacagctttgtcaattccgactaatgcccaaaacagttccatctctaaaatgcgggtcgacgcttagggatacatctggatctaaagcaggtccatttaccataggttattacaagccagcgcagcatctccgctggatattacagttatgaccaagagggtttgagagctaagaccggagattccctattgttcattaaccgcgttggtatcgaca

SEQ ID NO: 7124 - DNA, 353 bp, Bacillus thuringiensis
ctcactgggctttgttgatctgttgaggcgggcccgatcagtgaactcaaatgtccagatactgctcttcacgtaatcaatggataacccgtgagtactcctgtttgtaaccggcctgcatatggccagaagccaaaagaaggtccaagagatgagttatatacataggctacctcccaactgtggagctacagaacaacttgggttatacatggaggtgctgatacgcccacttgctttactagatccaaatatataccctgtaaattgcattttgcggagtcttgatgcatagccgcctgcatcaagactcgtgtcctattgtctggattggagaagcgattgactgtgta

SEQ ID NO: 7125 - DNA, 173 bp, Bacillus thuringiensis
ctccagcattaagtatcagtgtcgtaaactaatggtacaatttttttgacattcgcggagcgaacgcagcttctgggtagatgtcataatcacaagactattgtacttcgatagcctaaactacattggcggcacagttttgtaactttcggataatacctaaaacagtttca

SEQ ID NO: 7126 - DNA, 184 bp, Bacillus thuringiensis
ctccagcgacaagtattagtgtcataaacgaactgaacaattttttttacattcgtggtgcgttcgcagcttacgggtgggtgctatcatcacaagaccatgggatttccccagcctaaattacataggcggcaccatacgatagctttcggatcacacccaaaacagtctaaactttaagtat

SEQ ID NO: 7127 - DNA, 316 bp, Bacillus thuringiensis
cacattggagcgttatttccgggtgatgcgaaacgcatcagaggggccacatttcaaacgactgcacctaacgtccacaatggataaccggatggtacacatggttgctaccggcatgcatatggccagacgacacgactagatacaatggatgcgttaaacccagagagtaccctcgaacgtgcagctacagcaaaactggcgttatacgtagagctgccgtacggtctacttgctggacgagtaccactatataaaacatgaaaatggaaatttgcgcagtcttgatccatcccagcctgcaacatgacatgtg

SEQ ID NO: 7128 - DNA, 416 bp, Bacillus thuringiensis
gtcaactgttttttaggacggcaaaaggccataaacagggggggggcctcacgactgaccttgggtcctaacctccggccaggggacgggaacgataaaattgaaggctgaggggctgaatcccttaggtagtttcggctttccagacattacgcattaaaacctccaagcacgctagagcggtccccacctgacattttactgattaccggatacctttccgactgtcagaatgcgggaggcttgtcaatatctcacccggtaagctgcaagtttccgggttggctgtctgtctaaggctggaagctgacttatacccacctatcaagctgtgagtctgagctttatgcatgacactccatctagggctttgtgcgcgaaccaacatgtcaggacttctgggcgctgccattggt

SEQ ID NO: 7129 - DNA, 215 bp, Bacillus thuringiensis
aacaccggcctttatgtatcgcaaaaggccaaacacatcaggggggccacataacgaacgactgcgcgtaacgtaaacaaggcataaccagagaacacacaagagagccagccggcttgcatacggccacacgacaggacaagctacaaagcaggcgtcataaaaagagacaaccatcgagcgtgcagcaacagcaaaactggcgttaaacatag

SEQ ID NO: 7130 - DNA, 378 bp, Bacillus thuringiensis
cgggttccatgccttttatgccatatgagcgagcctaatagcagagcttgagtagatgttacagacagcctatcaggcaggtaactaaggcgggggaataaatatacatggattgcccactcacggagagatgatgaataacttatacatcgctcgataagttacccaatcagtgactcaatagaactgcttcccaatgctatgtattgcgttgtgatgtaactaaaactcgcccatactgatagtcataaaaagctggattctctcggacaacatcatgtcattcttgtggcgacatagggtcttgaacaacagtgaggcccacgtacatgatcctttacatatgccctacacattagatgagcatgcacaaaatga

SEQ ID NO: 7131 - DNA, 115 bp, Bacillus thuringiensis
ctgaacttagataaaggaatgcaaacggccatacacggagggggtgtattacggatgaaatcgcttatgagcaaaaggccagacaccgggcaccaacatgaaagaggccagattg

SEQ ID NO: 7132 - DNA, 404 bp, Bacillus thuringiensis
ctcacctttatcttatggccgacagactgccacacacggggggagggtttaacgaaagaccgcgcatcccaccaacaggccagcggacgggcatcaaccaaagcgcggccccgtggctcgataccatagatatggctccgcccgcctggcatgccacatataaacccgccgctcaagcgagagcgagccccaccggacaggtcaagaaacacgccaggccccccccgatgtacgcttgcgcgagcgctcgcccggaccgacccggtaaccggccacatgcccgtccgtcctcctttcttaaggaagagcctgcctcaatcatacctttagctgtagtgaaactcaagcgggtgccggtcgccccacccaagctgatctgaacgaaccaccccttcagtcagtcc

SEQ ID NO: 7133 - DNA, 359 bp, Bacillus thuringiensis
ccaattgcttttttataccgtgatgccaaaaaccgcgggagggccgcgtttatgacatttgctcctaacgtccgcccagcggcagggaacgataaactgggaggctgctggccggtgtccctaaggtcgacaccgctggccagaatccatgcattacacccttctagcacgctcgagcgctccccaccggacaatataaggataaagggatacctgtctgactgttgcaagctcggtagagcgtcactaccttacccgttaccctgtacctttccggactgtctctctctccaagcgtggaacctgactcgtgcccacctatctcgctgtctgtctcgccggtgggcgtaacactccac

SEQ ID NO: 7134 - DNA, 224 bp, Bacillus thuringiensis
ctcaccggcctttgtttatctattgaagagggaccgaacaggggagtttaaaatccagttactgttctgaacataaacaagggataaacaaggggtgctcatgtttgtaaccggcatgcatatggtcagaagccaaaagaaggtacaatagttgacttataaaaagagagcaactcacaatctgcagattcagaacaacttgccctatacatggaggtgctgat

SEQ ID NO: 7135 - DNA, 327 bp, Bacillus thuringiensis
cccaacttattttatggacgccaaaaggccatacaccgggggggtttttaacgaaagaccttgcatgcaaaccaaaggccagcggaagggcaccaaacaaaggccggccgcatggctggtttccataggtaggctccgccccactggcaagaatcatataaacctccacttaagagagagcgagcccaaccggacatgtcaagaaacataccaggcctttccgccagtaagctcgctggtgcgctgtctaggaccgagcctgtaacagaccgcatgccggcccgcctccctccctaagggaagcggcttgcttatacataaccctcg

SEQ ID NO: 7136 - DNA, 101 bp, Bacillus thuringiensis
gagtcgtaccacttgatgtgccgcctgccattgcgcatccctcaacgcgctgatcgaggcaagatgcgtgttcccgctactgtcgttgcgatcacttacta

SEQ ID NO: 7137 - DNA, 221 bp, Bacillus thuringiensis
aaaaaattcctctgaaggaacgaactcatcaaccgacgggggcctgtcagacgccccccccgtcagcaggcaaataaaatttaccggcccctaccgtgcgagaaaacttacgtacctggttgaaggaagtggacagacaattctaagcacgcacccgtctgcatcccaaccgctcgagaaggaaggacggtcatttcaatcaatgaagggtgggcagataa

SEQ ID NO: 7138 - DNA, 362 bp, Bacillus thuringiensis
cagatcaagtgtctttactttgcggaccatttatttttgccttgagtacgcacgccgaaaagcgggtgtagtttgaagtacccatctgagcgttccgtagcgtggttaagtgcttacacaactgattctgtaggcacgagcacactggctgtccgcgtaaagagagacggctgctcagtaagcgggatagtatacagaaacggttgcgctcgtgaaaggtaactgacgtgctgacggtcatgtacttacagcacatccgtagtgcgcactgcccgcggcaaatattgctacagatagtaggtcagctattgcaacaaaagcagggtgggcctttgaaagttagccactagcttcaaagcctg

SEQ ID NO: 7139 - DNA, 391 bp, Bacillus thuringiensis
caacggcgccgcattttcccaaaagaaccgagagcttttctctagccagaggccttaccctgacagcaggtttatatttcacttgacctttagacctcacaacctattcaggttgatgcacaactgcttcccgggtccctgggacataaacccactgcgccgtatctggctgctcggcactcagaaggatagggaaagcaatctctggccaacttacagaatatgctggcctgcggatgaacaacagcgtatgggacgagctctatatcccctatcggaagacgagttgccacacttaacacatctgacaaaacatcttattcacccatagcaccttcaaatcccacaataacaccgaggccaataccaggtgactctacgccaactactg

SEQ ID NO: 7140 - DNA, 183 bp, Bacillus thuringiensis
gggggctatcagtttaggagacgcctaacattgctcatccattagcccagtgaacgcggcaagatgcaagtagcctgaaaaatgtattaaatgacgatttactaggcggaagtaaagtacttgttggctatcgtatttatgaccgtcgtttacagggaaactgggcacgcattctgcgtgagg

SEQ ID NO: 7141 - DNA, 347 bp, Bacillus thuringiensis
cagcgcggtctgcagcccttttcagagctgttcttttcgcgaagccttcactggcttcaccgaggcgttatgcaccatacactgagctttctgcgctttgtagcaattgaactgtcaatatactttttctggatggcccaccttcataaagtgatgaatattcatcacacgccccttcagaaatcgagatatatgcacaagccgttgcctttcttgaaataacacttacaacgcgccggaagtttgtatacaagtcattttcagcgccacatgcactcatggcgtatgctggtgtggcataggctacactcccattcgatgacgagtggtcatacaattgtactacg

SEQ ID NO: 7142 - DNA, 139 bp, Bacillus thuringiensis
cacaccacgtgtctatacttctcgaaccatttgttttttgtaagaaccggcacccccgctggctggtgcactgggggctacccctgaagcccctcgtggcagtaggacgctccacacatttgctttgaaaggcacatgc

SEQ ID NO: 7143 - DNA, 384 bp, Bacillus thuringiensis
cgagacgtgatgcgtcacctccactccccattgccgtgctgttggtttcgcgaacactagctccaccgtcctggtggtgcacctgacactgagctggctgccccttgtgggaggagggctccccacagcacttcttcagaaggttatttatcattagccgtccgtggcttgtctgacaccccatcagtaaggggcttttgacaattatacgcttcctcgcgggagcaaagacctacactggagatgcagtgatgtacatcttatcataaagcaccattgatcaggcatgctctattgctcgctaagacagggctgtcatttcatctaatgatgggtgggctcgttcttctactactctcatcattgatgaccaagacgcggcgt

SEQ ID NO: 7144 - DNA, 304 bp, Bacillus thuringiensis
cggcggcgccgcattgcccttcaagaaccgagagcttatctccaccgagaggccctacacttacggcagggttactttaaacttgactgtgcgaccccagaacaatatcaggtccattaacaacggccgtccggggcagtggaacattaagccactgcgccgaagcttgctgcacgccactgagaaggcttgttaaagcaacttgtcgccagctttcggaaaaacttacctacgtatggacaacagcagatggagagttctatatatgcaccgtcagaggacgtgtcgccaaaccgagaaccac

SEQ ID NO: 7145 - DNA, 134 bp, Bacillus thuringiensis
cagtcgtatcttttgaagagccgcctaacattgctcacccctctcccctctgaacgaggcatgctgcatgctgcgtgtattgtgtcgcacattaacacttactagccgcaagaaaagcccctgttggaaatcgc

SEQ ID NO: 7146 - DNA, 259 bp, Bacillus thuringiensis
aaaccctttggtctccggaccatgtagcattaccgatccaaggaatataaatgcctaaggcacacctgcctacgaagaaccagggtgctccaaagccataacgaacagaatgacatggtgatgttcccaatcctcactggaacgcccacaaacgatatggaagctgaacatgtacacctcagcgcacacgccaatcatcaggaaggcaatagatgcggaatccatgaacacacggaccgatggggaggctaaaaataac

SEQ ID NO: 7147 - DNA, 379 bp, Bacillus thuringiensis
tggtgctatctttttaggcgccggctttcattgctcatccatcagccctgaggtcgcggcaagatgcttgtgcctgatctgtattaatactactcttgcgagtaaggccctgtgctatcgcattatgacctcagtgtacggcggatactgttcccgcattcatcgtggataacgccgatcgatcatgttgcaacaatgagcattagaactggaggccattagcaagactgctccagctggcgatgttacatctattacgccgaactggcgagtagtgttgtagttaccgctaaactagtaggtggcggcctcgcccgtgagtatggtcttgccacccgtatgcctctggaagttgcatagttctctaacctcgtgatac

SEQ ID NO: 7148 - DNA, 414 bp, Bacillus thuringiensis
tagtgatatctttttaagcaccgccttgcattgttcatccctctcccctgttaacgaggcatgatgcagttagcctgatatatcttgttaattatcagttactatctgcaattaaagtacctgttgggtatagcgttcattgcgtaattacacgaggaaaaatagctcgcattcagcgtgcattaactgctgaatggatcatcttggagcacatgaccatcagatctgcacgcatcagccacactgatccagctgcagatgtagcacctatactccgcactcgagagtagtgtggcaagtacagctcttctagtcggtggcggcgtcgcgcgtgctaattgtcatgctaccggtatgacccgcgtagttgcatagttctctaaccgccttatacgacgatgacaatacctagat

SEQ ID NO: 7149 - DNA, 438 bp, Bacillus thuringiensis
ggagagctatttgcatgaggcaaggacactcacgtgagtgttttttccacacgtctttgacgcagcgagcatcttcgacgatggtaagtggactggccatacaattaacggagtctgcccttgagtgaacccacaggtttggcaatttccaccaataggccacaagcaggtcccctcctttaataatggcgggggagaacaacaacaggtatcacttcatggtgttttaagcggatttccacctaaacttatgcgttttcacgaagcaatggcgcagcgttcttttcaaattacagtgattactagcagggggtgctaggtaagactggagattccattttagtcgttaagagcgtatagaatgagaggcgctattatgcgtcacgttttaataatactagcattctatattataaggaaaccttgtccttagttgta

SEQ ID NO: 7150 - DNA, 215 bp, Bacillus thuringiensis
ctgtcgtatcacttttttcgccgcctaacattgcggaatcctcaacgcggtgatcgaggcatgttgctggttgactgacacatgtagcaaattatcacggactatgcggattaaaagtactctgtggcaatcgcattattgactgaagttaacaaggaaaatcgtctcgtcctcagagtggattaatgaggaactgaacagcttgtggcacatga

SEQ ID NO: 7151 - DNA, 160 bp, Bacillus thuringiensis
gccccccacctattaagcaccgcccaacatcgctaaaccgggggccttgttaacggggattgcggcatttacccccgaaaaatggcgctgatgaaaatgcactatgcgcaagcaaagtacctatcgggccacgcgtctatgacagacggtcacaaggaaa

SEQ ID NO: 7152 - DNA, 122 bp, Bacillus thuringiensis
cgacgacgacagctgatgggcgccattttatgcaccgccatcgaccattgcacacccctcggccgttttgacgagacccgcctcgtggtccacaaaatgtgtactataatacaaacgacccg

SEQ ID NO: 7153 - DNA, 323 bp, Bacillus thuringiensis
taggcgtatcttttttagtgcggtcactcactgcgggcacatttccactgaaaacgggtcgttccgcatgctgcgtcacttcatacactacttaaaacaacctgagcgcaataaagggctgtattgaaaaatactgccaatcccggatgtataggaggaaccattggctgaactgatgctgtgtaatgcctgacgtgaggattgaatgccccgcctacagcaaacctcgacccccatccaaacgagttccctaacagatgagcgaccattggccatgacctcaagcgtagtattaagctcactgctggacaaatcagatacgg

SEQ ID NO: 7154 - DNA, 317 bp, Bacillus thuringiensis
ctgcggtgtccgtagctctcattggtgcggttattttcgcagagggtccacaggctaaaccgagttggagaggtccatacactgggctatctccctcgcgtggcaagtgagctgcagaagcgacttcagacgatgttggacatacatcagctggcctaattgaaacacacgacacatccgttagcagtgaaattgtattctccggtgcctcgcgcgaaagatgacgtacctattggtagtcacctatggacggctgatcttaagcacgctctgacagcattacaacttgctagagatgcatggtggggaatatcatt

SEQ ID NO: 7155 - DNA, 324 bp, Bacillus thuringiensis
ccacaggcccttcaccgtcacctggggtacttttcactagactgtgcgcactcactagcgtgtcaagtgctctcccaaatgccgcccggggctctgggacataatgccaccgggccggatcagtctcctcttcacccagctggattgggaaaggaaccgccagccagcgcgaagaaaagcggacgtgctggtggacaacaacgtacgggacctgcactgcacccaccgcctgcggacgtgtcgccaccccgagcacctctgtccgtagcaactatcaatccagggcacgtacaaaatccccacacacatggatgccaataccag

SEQ ID NO: 7156 - DNA, 400 bp, Bacillus thuringiensis
caagtgcgccgccttttcctaaagcaaccgagagcttttttttacctggtggccttacactgacacctgttttatgtgtcacttgattgtgagcacacacaactttttcaggtcctttcagaactgctttccgggttcctgggacattatgtctctttgacatatcatgctgctctacacggagttgtgttgtgcaaggaacctctagccagcttactgaatagcttgcctgcatatgaacaaccgcgtatgggacgtggtctacatccattttcgtatgccttgtcgcgacaccgagtacatctttcaagacatcttattgacccattgctcgatcaatttgcactataactttgaagcccatacgatgtgactgtacgccaactactgctggtatgac

SEQ ID NO: 7157 - DNA, 137 bp, Bacillus thuringiensis
ccaggtccatcatcaaatgttaaatatgcaacttttctatcttttttattataaacgagaggtatcaatctttttaatgggggggtaggtagactgcttacttgctgaacactatttgccattttcgcatttaccag

SEQ ID NO: 7158 - DNA, 283 bp, Bacillus thuringiensis
attatgctattggttgggaacgaccgtaaatttgtttttttgcgcccagagactatgaatatatcagtgggaccattcattgcgaaaacggctgccggagctgttatccatgaaccgaagaatatttcggggatcatcaccctaacgcattaaatgagatgcatgctaaaacagttacaagtggattcgtaccgatgacgtggatattatcgctcaattcagctatataaagggattgaattatcgagtggatgacaacgaacagctttcttattgtgagtga

SEQ ID NO: 7159 - DNA, 156 bp, Bacillus thuringiensis
tcacaaaaccacccaattgttgtcccagcggccttgacgattaaggacggggggcctatccagcgatcgatcccacataagttgcacaggcctgactgaccgcattccacacgggatacctggaaaacaagccgcatatgaaaaacaaccaacgct

SEQ ID NO: 7160 - DNA, 244 bp, Bacillus thuringiensis
actgtgcttccttcgaagtgttctttacaaaacgtcatgccctcgctctcattgcttggaaaactgaggtccggcaagcgacagggtcacagcaaattgtggcgaaacatctctttctaggggaaacacctgatctaattgcgatgctactaggtttcgccacccctgacctgaacgcaaagcttagagatgctcgtcaagagaccaggatcgctatgaatacacctacaccaccgtcactatg

SEQ ID NO: 7161 - DNA, 219 bp, Bacillus thuringiensis
tataagtctccttatcatatatagattacatgctgacatgtacagacgaacacattacccagacgttaaaccatcataacctgcctaagcctaccgtaacatgtggcaaaatcaatgagtctcgcgccgatgccctgtacatgaagaacgaaacgttatttcgcgccatcccgggattagcagaacatgacaagaaacttacgggcatatatttatcca

SEQ ID NO: 7162 - DNA, 163 bp, Bacillus thuringiensis
  unsure (1)...(163): unsure at all n locations
atagtggataatgactgtttttcactttcatcaactatagatncccctcgaataaccttcaattttgtctttacaatgatacctagcgattccaagtcacaactgacacgcttttcaatattcaacggtctctaactacaaaacaaactattctttcatcaat

SEQ ID NO: 7163 - DNA, 131 bp, Bacillus thuringiensis
acctattggtggtttcaacacctagccaacaacgcgacggggggggtattctcgatagttgcgacgaaccacataacgacatcgaaaacgcaatcgaccaacgagagggactgctaacgtgtaacccagat

SEQ ID NO: 7164 - DNA, 337 bp, Bacillus thuringiensis
acagttaacctaagcgagttgagtgggccgtgcacatcaagtttttttagagtatatggcatgacacctgctccggtgggtaccgatgcagggtaagctgatgggaatagcgctaaaacggatactggttcaccatgtgagtgtaattgtgcagcagacggtgagccatgtggagaggacacaactgattcaggagttgtcactgttaatacaggccataatcccacccctgacgtaatagaaagtattaaacaagtgcttaagtgggactacggccatattgttgccacattaacaaaattgtgccgtgacatggctgcataagccatgtgcagcg

SEQ ID NO: 7165 - DNA, 112 bp, Bacillus thuringiensis
cataaaagcccaactggctagatctgattaaagaatcactttaccaaggggggaactttaggaatatgtacctgccgacaaaaaatatatccattattaatggatatattca

SEQ ID NO: 7166 - DNA, 158 bp, Bacillus thuringiensis
gatgaagcttggccaccaattcatatacgtgtacaagccttttgtcttcataatgtattgaccagcttaattacgggtgaacactaaaccttgcaccggatacagatttaatcacccacagctcccttgtatagactactcgctgtgtgatcatttta

SEQ ID NO: 7167 - DNA, 440 bp, Bacillus thuringiensis
tatcgatccacgacttcgtgattgcacgacgtttagtgaagtaagtggtgctgctggtttcagctgaagcttctgttgccatccctaatccgacgaacgctgtgattgctaacgatgaaatccctagtgctgctttttttaacataaaaacatccccttccatctattgttttctctttcattgtcaatataatcctaataatcttatatgtaaatagattgtaactgcagaaataatagaaagaatattctgatttattaacattgaaaaatatgacttcaacttttttcgttaaagatagtcattaatctctaactacctaatgacctcaaataaacgctattcaagccattttaagaggtacaaaagaccttatagtatataaggtctttcccgacactctggaaaaaccccgggaatcattcacgggttttacttt

SEQ ID NO: 7168 - DNA, 172 bp, Bacillus thuringiensis
agaaagctcatcaacaccccacacaaaactgaagaaggtcgcctactttacttacactacacagactattcgtttcaacagtaatcaccgataccagatataactagaaacaagaatcacgttcatgctcttgataataacgacaaaaatagccacgccgatataaacgatt

SEQ ID NO: 7169 - DNA, 235 bp, Bacillus thuringiensis
tttataacttttacttattaaacgaaaacccctctaaaaatatagctaacaccctggataaaattaaaatatctttttattttaaacacctactttcgcaagtttgcgtgataaataaaatgtcctttcatactacctttataagtataccagacattagattgtgcgaaaagattttgatgatctatactaaacactgaattgtcactaaaactcagttcttgcataactaaat

SEQ ID NO: 7170 - DNA, 238 bp, Bacillus thuringiensis
ttggcgttctagtttactctggtagcacgtttatctcgtggggagcgggattttttacatctactacaaatgcaacgggtatttctaatagtatttccttctaacatagagcgaatccatgtagtttgtacaggccgtgaagtgtccgtcactaataatacgaattgttcttaaatctgctagctcgtcaactaaccattgaaacgggagacctattgcgatgttctgctcttgagcc

SEQ ID NO: 7171 - DNA, 298 bp, Bacillus thuringiensis
gaacgactgtctatatgaggccggaagtggtcaatacattcatcaatcgctaggactgcctacattgataaattccaacacccaggatgatcacggggaccagcctctctattcatagaaccagccatagaggcaccctcaacaaaaggggaaacagccttataatgtgaaatgacacacccttgccgagattaggtggaacacttgactcaccaattaaccgaggcgcatactgctacctcaatgataatagtgcctgacgcccatcgtttactagagcaaaccccagggcaccaag

SEQ ID NO: 7172 - DNA, 150 bp, Bacillus thuringiensis
  unsure (1)...(150): unsure at all n locations
ttcgtgatttgccgattnaggnctatcggataacaattttgttttttcaacgaaaatctaactagaattgggggattattataacgatttccactctcattcaactttaaggatgttcaagtgttgggcaagctgactttgtttattcta

SEQ ID NO: 7173 - DNA, 383 bp, Bacillus thuringiensis
atgggtacaagttaaaagacgagcggtctttaagagcaagagtgcgcatttccccgtgttatattgaagcaatagtaagttacacgaatgctgctacaaacagttctaagaataaagatcactgcggtccatatcgtgaccgattattggctacagtcgcgccgcacgtgcttcatatgcttatagtcacgaaagcacggccgtactgctctagtacatctttagttaacatttcacacgaaacacggaacagagatggcgcagtttaatgacagtatacatatgcgataagtggcaaaacacaacttataagagtgcgaaccggtcataacgccggattgttatgaaaacgaatagacgagataccatgtatgcgcaccacc

SEQ ID NO: 7174 - DNA, 180 bp, Bacillus thuringiensis
cgagcataaatgacgaagttaccataaaatggattcacactaccaattgctgttagtgtagtcgtacactgctgcgaataccattataggttttctataaaatgggtctcggtaaggacggaattaaatcacctttacacctaactggccggaacctgtgatcatcaacttcttgagaga

SEQ ID NO: 7175 - DNA, 106 bp, Bacillus thuringiensis
ctccgtaaccactaataggacgctagaatacggggtaaaccttagccatattaaagcattttctaacctacatgccttaatggactaaatcccttctatatcaaaa

SEQ ID NO: 7176 - DNA, 179 bp, Bacillus thuringiensis
aatttaaaaagaaacgattctccattttggggaagaaaaaacaacattaacaaatataggcacaagtagtggagcgataaatattacacgagcataaaaaaatgaaaattttcatgtggaaaaagtacatattgcacaaaaaaagcatattgaagttgcaaaaagaaaatgcaaaaaac

SEQ ID NO: 7177 - DNA, 247 bp, Bacillus thuringiensis
cttgcctattgttgtcgcaggagactctattcggcgttacaaaggacacaggtagactaagcgacttgcaatggacccttctagagggtaacatcccggtagaaggtttcattaactgtttgagggacttcttcttatggcggtggtacacgataatgtcagtggcttttttaaaggtgaaaaacttcgggtttataactgcctagtgaacgatagtcctcctgtaacaagcggtaaaggtggttag

SEQ ID NO: 7178 - DNA, 430 bp, Bacillus thuringiensis
aatctatgaatccgttatttataaaggaaaacaatcattacaaaataattggtgattaataacaataggactctgagcataatattgcgtatagtcctatttttcattatctgggcaagctgacttaatttattctctacttgggttaatgaaagaagtattaattacatcataaccaccataaccgctattattgtatgtgggtatctaaacaggatactacataacactttcaatgaacatcatgaggcatcacgccttgcttgatcacttttgctctatacctggtacccgcatcccacaattgacttaatttttcatagatcgtctcgttcgataaccatttgccgcattaatatgggtcggaggattcctttgaagaacacttgccccaagcataaatctactacctattaaaaatctcattcct

SEQ ID NO: 7179 - DNA, 118 bp, Bacillus thuringiensis
tatcctcctagatgttttggcagttgctgcaaaaaggctagaggagaatagttcgggccaacttttagacagaatgctttattttaatggctatagactgtttcattgtaacacgttt

SEQ ID NO: 7180 - DNA, 309 bp, Bacillus thuringiensis
cccctgggatcctcatcttatgagcccgcctagatactatgctggtccaccgagagacaatgtgcaaaggttgacgacctgcaactataacagggacaagggtctaactacaattgacgcttgagagcttaaactaacgacatgtgacacgggaacgggggagagcttcactgccaggaccaccatgcaatgaaggcctattcgttcaaaactggagaacatggatacatactatatgggtaagacccagatctattagtaatcgtcaggtccacatgtctccatggtgccacatcgcacctatcatcc

SEQ ID NO: 7181 - DNA, 256 bp, Bacillus thuringiensis
ggacgagggctttactaagcggcaggggaagcaccgggcgggggagggaaaatttcagagccagaaccggaacaaagggaagcagaaaagccagggaagaaggacacgccagaaggggcgccaggaagcgaacctggtacgttcacagggagaagagatgtttcctgcgcaacagaagccactcgatggtgacgaggcgccacagggatcacagataggcaaaccggaagagcgtgatatgaaacaggggcacgag

SEQ ID NO: 7182 - DNA, 412 bp, Bacillus thuringiensis
agacagaggcttgattatccgcccgcaaaggaacggagggaggacggccaaaatcagacacacgggcaggggagaggccagaccgacagaatggtggcacggcaagaccacagggggcacgagcgccggagagacgtacaagacacgagaagaggcagcgcgccgacagaaagagcggccacaagtgggacgatatcgtaccaagcatagccgggaagaaatgcatcgatatcacgcacaggggacactggaaataacaccagaagagcccaaaagcggaaaaccacacacagccggagaaggagacgccagaagaactagagacccacgagcaaaccggggaccaatcaaagcgaaaacagcaaaaacagcagcaacaggagcatggacacgccgagacagcgcagcaagc

SEQ ID NO: 7183 - DNA, 180 bp, Bacillus thuringiensis
acaacacttagtagtccaacaagagctggcttccatgtccgccgatttgcccgattcatatccgactattttactagaaaagaggtctcaatggacaagctgaagctaccggctgctgtaatagcggagcatgtagcgaggccggcaagatgtaataccagactaggtaccgatcatcgg

SEQ ID NO: 7184 - DNA, 153 bp, Bacillus thuringiensis
  unsure (1)...(153): unsure at all n locations
cgtcatactagacggaagtgcgtagcgaaggccttcatantgaacacgttgaagggaaggggttcgagtgttataagcggaagccccgatttcaatattattgccgctataaaaacgtccgtataccgagacccgcgtattttcatttgtata

SEQ ID NO: 7185 - DNA, 294 bp, Bacillus thuringiensis
tggcactggtttagcttaatgagtactttctggaccagttaggcaaaagcctcacctcatatactgcacaactcccgtacctatatccctcaagatatacaatcaactcatttagatattgtggaacattacgctgagtctctatctcttatagctgcacagagaccctatagacacctatacacattcattgctgcccgtgataactgctctgcagaagcatctctagctgccgtgctatactgagctccaaatacataagtaaatatcgaaagcccattctctgctcattca

SEQ ID NO: 7186 - DNA, 212 bp, Bacillus thuringiensis
aggtgcggccacaggatcttatcatcagcataccggacacgcactgacggggtgtttaccttcatctgtatcccgaaagcatccacacggacaggctccaagtaaagagttctatcgaagtctaattgaatagactgagttcggggtccctaacgtgagctaggctgaactctttatacttttcaattgctacttgcgataacagccttatc

SEQ ID NO: 7187 - DNA, 154 bp, Bacillus thuringiensis
ctaatagtctcaacactacatactctacggacacatctcaattttagaaggggggtaattatatgataagttggaaatccatacaatatttgataagcctcatgcccataactctgatttctttaaataaaacgtaaacctagtgactatcgtt

SEQ ID NO: 7188 - DNA, 316 bp, Bacillus thuringiensis
tggaccgatgtgcattggctttcgacattcccacgctacatattgttgaccattggtggtatcatactcgactagcccatttacgacctggggacctaactatgcggcatagacggaggacgggtatgaatcaacttctgattccatgtatgttgccatcctatgcactctgccgttgctgagtggtcctccttcagcacagaatacggctctgatcaacgatataggtgacgactataccagctatctgtaataccgcatgcgcattggagtgcacgaagtagaatttaccatactgaagttacagaccaaaaac

SEQ ID NO: 7189 - DNA, 396 bp, Bacillus thuringiensis
ggaagaaaaaaaggggggaaaaaaaaaagggtttgtaaaaaggaaagagaagaaagaggaagggggaagggaggaaaaagaagaaaagaaaagaggaagaaaaagagaaaaaggagaggggagagaaggaaaagaaaaaaagaaaggaaaaagaaagaagagggagggaaaagaagtagaaaaagaagagggaaaaaaaaaaagaaataaaggaagaaaagaagaggaggagggaaggaaaaaaataagagaaaaagaaaaaaaaaaaaatggagagagagaaaagaaaggagagaagggaaaaaaagaaagggggaaaaaaagagagggggaagagattgaggaagagagaaaaaaaggggaaggaaaaaagaggagagaaggaagggaaaggaa

SEQ ID NO: 7190 - DNA, 167 bp, Bacillus thuringiensis
aggcgagcccaggatttcttcgatgtggaaaacacggcgggttataacgacgctcagttcggagaaaacataccacctgcatttataaatccttgcgttaaacactttggaaaaaggcagcctcatttaatggagccaaggggaatatcccaaagatatgtacatgg

SEQ ID NO: 7191 - DNA, 376 bp, Bacillus thuringiensis
tgtattaaaaaaaaattttttcatcatattttgggaatactctatataaaatctagctactggctcatacgctccatagcaccctatagccatgctaaacaggcgcaactggaatgaaaatgatgggcgcgaacgaaatctatatgagaattcacaacatgcgacgagtccatatatgccacgtggcacgtgctagggggactataatgattgccacgtattgatacagcacatgcactagagaattaaaagacacagggttaacatccatactggactcggattaagacactacttgatgagaattataaggccatccctgactacgcagtagaaaacgatcgtcgaaattatgcagaccatacgcttgattcaa

SEQ ID NO: 7192 - DNA, 251 bp, Bacillus thuringiensis
gagaagctgcttgacgacaaacatcagatggtcaaccaaaccgtttagtagttaacacaactctccaagttgatcaataggggccactttgagtcacaacgcgaaaaaccgagccattagcataatttcgtgaatctgttattaagctgtagcagatggaacgaactctcaattgggtgaaaacgtgttgcatttcctggcgcaactacataaactaatgaccatgccacccataatgaaccgactggtct

SEQ ID NO: 7193 - DNA, 210 bp, Bacillus thuringiensis
aagagggcttgtcatcttcgcaccgggaggactacaaaacgctggggactttggtgctacttatttggcagcagatcagcaaggtgatgggagtggaagggttgcgttacaagcaggtcattaaggcaccaaatagggatacttcacatctgtacattccatggccaagcataagaatcgtgcaaggcaatggctattatgaagccaaag

SEQ ID NO: 7194 - DNA, 146 bp, Bacillus thuringiensis
catttcgtgtgaattacggaatgctattgttctcaagggtcttctttgccgcgagcggttcattaataattgcgggatctgttacacttgcttctagggttgaagaaccgcattttcgggcgcgtgcaatcgaaaccactttcatg

SEQ ID NO: 7195 - DNA, 159 bp, Bacillus thuringiensis
gctcgagaagcggcgacgaattaaatggtcaaccatatcaaaatttgcttagtcaactctccaactaatcgtaggggaactttcattcgcaacggtaacccacctaagatacgttatgcaccagacgctttaatttacagcagtgcgtgctgtaagccc

SEQ ID NO: 7196 - DNA, 117 bp, Bacillus thuringiensis
gttccccgcatgataatcttatatcgatcactctagtgcaatcacggggggtaactttgaatggctcccgcttccgacatctaatataagtataaatacatccgcatcatatacagc

SEQ ID NO: 7197 - DNA, 214 bp, Bacillus thuringiensis
  unsure (1)...(214): unsure at all n locations
gcgtgatacctggtgttaccaacattcttaatcgacgctgcnatttaacccacatcacctaccgttaactcgggaggtagttgtagtataggagcgcaaacttttcgcctaggtgcctatgacacaatacgaaccaccatcatacgagctggcgagacaagaaaaccacgaacacggccccagacttcttctataacttcaaaaacaactggat

SEQ ID NO: 7198 - DNA, 187 bp, Bacillus thuringiensis
  unsure (1)...(187): unsure at all n locations
agccaagagaaccgaggagggctggcgtgtcatattcgcgatatggacaaagactacccnccaagtccncacccttctcccgcccgccccgcaccgccgccccggcttcctccctcatcataccccggcccgcgccaccccccagctgaaaactggccccgccccgcaacggcgccacgcccaaaat

SEQ ID NO: 7199 - DNA, 418 bp, Bacillus thuringiensis
acaaccaaaacttgcactctctacccaaccaaccaccagtcaggaaggggtaatttcaccttgactccggggacaacgacacacaaagcactaacattcggctattagatctaccacaccgccaaactgcatcatatacagattcaaacagaagggataatccttattgccaactgtcgcaccaaacgagttatatgctaacctcaatctaaagcaaccggtattcatccccacccttgcactaacggacagcggaattccacgaatgatacaatcactacataccactccacactcaattcaagaggcacacttacagacgaatagttatacagatataccaacagcctcctataacagacgtataacctttgatacatctaactgtacacaggcgaaatcagtgcttactaaacca

SEQ ID NO: 7200 - DNA, 248 bp, Bacillus thuringiensis
actcacgaaactttccctcaaaaacggaccaacaccaacaaggggggggaaaatagaaaaggggtgcgggaaaacccccgacaaagagagggcacagaccacgagtcgagccaccataaaacaaaaaggctcgcaacaacacccaaagaagcaaggaaaaagccgcaacacaaaaggcaacaccaaacgcaagagaggctaacaccaatagcccgaaacccgggaaaggcccaagacggtaccaaccg

SEQ ID NO: 7201 - DNA, 183 bp, Bacillus thuringiensis
gatcgatcccaatacgtgatcggtctgagtttacaccttgaccaacatccaaacatgatgatagagacaccctcccccatttccccgggatcctgttataaacagaaatgatgcacgtcttgttcaggtgagaagggctatagcctaagagagatccaagtaactgttatccacacagctgac

SEQ ID NO: 7202 - DNA, 171 bp, Bacillus thuringiensis
  unsure (1)...(171): unsure at all n locations
cccagacgcgnacgcagcggaaccccaaggcgagagagagcaggcagaaaacaaacatgggggcacgcacattttgacacacgaccaaaaaaagccccccacgaggcaggaaaacgcgaaggacccgaaagaagaccaaccccaaaaaagaaacgcccaaggaaacacacc

SEQ ID NO: 7203 - DNA, 342 bp, Bacillus thuringiensis
atcggatccccacgtggggatcctgaatatctaccccaccatgttttcaaccacatagtgactcgcccgcaaggaagatcaaaatgagaggagcttttttaaggtacactaggtatttccaaaggcaccctgatatatagggagggaccatctgtctaaacggaatatccctgatacaagacccccacacagcctctccaaacaccaagatcatgaagtccacttattaatgcagcaaatactttcattgctacattcaaaatgaaaaaaccctatccaaactaatctaaacaaggctccatcatacacgaaagctacctacccaaaatgatgtccaattaa

SEQ ID NO: 7204 - DNA, 101 bp, Bacillus thuringiensis
ggtcgggtatgggtagtgcacattggggagctattgacataacgttctacgcggcatcaagcgcgcgcatacgtgctctccctgaaactgagcaggtagcc

SEQ ID NO: 7205 - DNA, 371 bp, Bacillus thuringiensis
caattgccagagattttttccggatccttaatatccttgcaatacgggagggtctataagcaaaggagagggcttgatggcttttattgatctgagctcactgtgtacaacctgtaatagcacttaaaggttatcttactttacgcgccactccagctgctctatgaccacatggtgcatgcaaatctgttataaatagcaatttatgcgtgattgctatatatgaaatggatcgttcattaactatcttttgatcatgttatgatgggaagtacctagtctcaactaaagaaatactaacattatgggtgagtggatgttctacaatgtacactcaggacctgcattcattactatgattaatggggaac

SEQ ID NO: 7206 - DNA, 153 bp, Bacillus thuringiensis
ctctccggattgcacgccccggacggggctttgctttgtccaattgacgaccgtagaaacagcccgcgcatcctgaagccgtaaccgcgaacccgaatcggcagtcaggcaagcgagcgagctagtgatctgaatacggacaaaggctcatca

SEQ ID NO: 7207 - DNA, 361 bp, Bacillus thuringiensis
agctagcttttgtgtaggtaacggggctacataaggacgagaccgggctgatggccggggttctatctttaatgcatagagtggctagtcgtaattacccttgacttcatcattcggcttgtgtcatgatagaggagattgtgggtctgtgagtttacacgccatttacctgtggtagggaagatgtgcgctatgctgaaacgaggctattgtggcgcgtgagacataccgggggtgcgatcatggatgaggcgcaaggagtgttagctggtcctgaagcggtaatcgctgctttaattgatgaagacaaaatgtgttgtttggtcccagagctggccataaagtgtgacgggggatttca

SEQ ID NO: 7208 - DNA, 254 bp, Bacillus thuringiensis
caagcgtcggatgtttattgcactggacgtaatacccgatcgcggcaggaatcgagggaatcatctgaactgccacccataagatggcaggcggctggcccgaggcggtcggaattggcttctttcggaagacgatggatccgcgtatgataaggcacaatggtatctactgtgctgtacggaaggtgggtagcaagcctttgtgcttgttctgcatggcgttcacctaaggtgtcaggacgactgtgacgacg

SEQ ID NO: 7209 - DNA, 433 bp, Bacillus thuringiensis
attcggagatgatatgaagaagttagctggtttgcgtttatcaagaaaggggggctagctatggtggctgggctgactgttcatcgacgtcataacctatcgctgatatatcttcacgatggaatcgtcgcgaaaaggtacttgcgcgagagcattctgtcaaaaggccaatggattcttcgctaaagatatgtctccctgactaatcatttgaacccatggacgatgatctagaatagcaagttaccaatgttcatgtaaaagaggcagaactcacctttttcgagatagatgacactatggtgctctaccgttgcctttcgtgtcgcgatcccatataaacctgtggtcgattttcaaccagccctgggtacatgctaatataacagtggattatagtagtcctggtatctacgctgcgggtgacaattgc

SEQ ID NO: 7210 - DNA, 154 bp, Bacillus thuringiensis
caaacatttacaacactcgcaacactttttctctccaatcccttacaacgcctcgcgaacatttactaattcaatgccaactaaaagaccttatcctctaataaccccaacaagcggatgatacccaattccatcttttagttgccctaataaa

SEQ ID NO: 7211 - DNA, 351 bp, Bacillus thuringiensis
agtttctcgatgccactcagtgttatgcacccctccaggcggtgttgcaactgggggagtatcaaacatacccactgcttttatcagagcagtctcaagagctgcccactttagagaaaggaaactctgtataccctgaatgagtaacataactacctgatacttcttctttatgcaccggtagcgaagaatgtcacttgagatgcaacaggtggcccgggagcaggatgagtatcttgtagtaccttcaaggctgtttatcacttcagccgcaaatggcccagatgcgcttctaaacgtataccgtgccacagcttcagaggaacccgagatttgtcgtacagccactaa

SEQ ID NO: 7212 - DNA, 254 bp, Bacillus thuringiensis
gcattggaggcagttttcgttgcagcggccacagcagatctgacccagcgggctaattgcggagggcttgatgcttgaatgattctacgcacacgcagtgggggacatagctacccagctatgccctcggcagacaacctgtttgaacaacggagcgggcatcacacaagaaggtcgctatgcagagcaagataaacgctaatcggactcgcgtcgggggcgtacgtgcccgtgatcaaatgatagagcggagc

SEQ ID NO: 7213 - DNA, 289 bp, Bacillus thuringiensis
atgaaaggccttgactcccttatacatcaacataatctatcgccataacggtgtgtgcaagtacccgcctgagtgactagtacacaattaagggggtgtacacatcaccctgctgattgcgcctatgatagcctatacaccacacgctgcgggggcacatcctcgctgcctgctcacttgtatattgctgacctaatggccgaatcaaaaactaatccgtcattttacaactgcagtgactgtgaaaaccttgagaaatacccaactaattgctctgagcatctcatca

SEQ ID NO: 7214 - DNA, 183 bp, Bacillus thuringiensis
caagatgggggcgtttttttttaccccgcacgcacgcccatataacgggggatgattacccattccctgcggtaaatccacgaactgcaaaacttaaacaagctcttagcattaaaccagtggataaagatgttgtatgcttatccccttgacctacaacaaccattaaacaaataaactgtt

SEQ ID NO: 7215 - DNA, 324 bp, Bacillus thuringiensis
gggatgacgctatacctcactcttacactaaaaaacacccctaatcatctctacacaccttcaataacatgcatgtggaaattttaaaaatcattagggggttcccacaacatactccccaatactatcgaactctccctagacttagaattcaacattgatatcaccaccatcttccacaacataatcccttacaacttcactctgatactctcctacaaccactgcccaaaacacataattctcaacaacagaggcctacacaaaattttcacctcgtacataagccccaaacccaagagcatccctgttacatgtcgcact

SEQ ID NO: 7216 - DNA, 239 bp, Bacillus thuringiensis
caaatcttagcttacattatggaaggatgcccgggatgcttttccatgcaccaatggaccccctgtcacatttttgacataaagtcatgggatggataacacaattgacatctataaaaccccggaagtcaaaggggtattacgttacattcgaattattccactggatgcccttaagaagtgaataggtgagagactggatgactggattgatgcgaacagttattttgaaggggcac

SEQ ID NO: 7217 - DNA, 146 bp, Bacillus thuringiensis
tatatcacagttttctttaacgcccgtaactgagcatcaactgaccagccatatccatatatgggattgcacgccctcgacacaacatggcacctcacagaatggggtccattccactcctgaacgcaggatggccgggcaaccaa

SEQ ID NO: 7218 - DNA, 102 bp, Bacillus thuringiensis
gctgggatgctgaggcacgaatccagatggaaaagaactcgtgggttctcaagtagaaggagtgccatcaacgcggggggaacttgacactggccgagggga

SEQ ID NO: 7219 - DNA, 318 bp, Bacillus thuringiensis
caaagcttacttcgataaggaagacaagaaacaagggggggggtcattttaagtaactgaggcacgccacccgcaaaatactccgccagtaaaagataaagaaatgcaaaatggaccgcgccaatagccggcgccaaatcattcggacgcccaactacctggccgacaaaaacaaacaacgatccaagcgaaaagaaagacagggacacataagcaggtgaacaaagggtacatcaatgaaggcgaggccccgaagacggaacgactcatggtagataacgacccagaagaccctaagcaggccatcccgaagccacc

SEQ ID NO: 7220 - DNA, 391 bp, Bacillus thuringiensis
gagaacgaatatagtacacaaaaagacgccccagaaaagttattacgcgtgcgggctgaaaggccgacagggggaacttataaaccggatccgtagaaccttctgcacaggctagaccgcgagtggggagctgacccggagtaactccgagacgaacaccataagggatggctggcgtactaggaccaacttcaccctgaacaacaacatcatggcgaacaataacgacaaggatcgctgcgatagcaccgaagacaccaaggacaacagcaagacctatcggatgactcggacgagagaaccgacggacacgaggaacacgggagaagactggaaattcggaagcccccgcaatatggaaagcacacatagcaaacggggacacacgttc

SEQ ID NO: 7221 - DNA, 249 bp, Bacillus thuringiensis
cccaacagttacacaatctccgtggggatcggaaatagtacgcgctacttacgaataaatctgggaacaattcgcgcatacatgatgtgcaacaaacaagctcggagaaaggaagtccctgaaaactaaaagagctccacccataagggttgagtgttgtaacaatttgtcacaacagacctatataatggaactagcactctaacattaaagggccatatagcgcatatcaggacaaggcacagtact

SEQ ID NO: 7222 - DNA, 316 bp, Bacillus thuringiensis
agataggggggagaagagaatgggttaggatcaattccacactcttgatgaacgagaactcctacagtagggggcaatattaatgaaatctggggtggatacactagtgaactatggcgctcacgtgattatggatgggcgtgaactggttaccaatggtgatatattcggctgtggtaatagcagagagaagtggtcaattgactgattgttttcgggtatgaagagaactgggttttggaacaaaagcccttttaaaacacttggtttctttgtgtttaaaaaaaaaaaaacaacaaaagtttttttttttttt

SEQ ID NO: 7223 - DNA, 305 bp, Bacillus thuringiensis
caacgctttctttctgggatgctcggttaacaaccgagtgggggtgtatcaaaagaaggatggtgtgggcaaattgccaacacggggggaggtacccaaaaaagggcacgtcgctgacagcatgccatagactacgaacgcgtgactggcgtgacgtatcacgacgattgcgacaggcgtgcgaaagcacaacagaagctggaagaaaccatgcgtctgcacctgaaaacgtgcctgaacgcatgaggggaacgtcccgacacagtacggattaccggtgcaacattgtccacctgcgcagcaag

SEQ ID NO: 7224 - DNA, 446 bp, Bacillus thuringiensis
gagaaccaatacgccaaaaacggcagtaacccccccaaaatacaacaacagaccgagataggggcccggggggaaccttttaggaaccagagccgtcctacccaccacgataatatcacccgctgcggcggcaaaaacactggtcggaaagatgggaacaagcggctgcaagccacctaatgtggaacgaccaacagaaacacaccaccacagagctggtataccaatggcagcaaccaatggaaatcaccataggctacatgcagacgcagtcggacgaactaaaaacactcagcaccaaacaccagaggacaatcaagtggaggaaggaaggcacccactcgtcacaaaacaagtgcgacaagggggacaaaccaagccacgacgcagagcattctaagagaacaacctcctaggaaactagctggactaacactaaccatcac

SEQ ID NO: 7225 - DNA, 122 bp, Bacillus thuringiensis
cgataatgtgcatgtggcactggatttgggcgcccaccagttaccacccaaccagcgagaagggccataggggccattttaaaaacggcttctcctgcttcccccaggcaagccatctcgaa

SEQ ID NO: 7226 - DNA, 340 bp, Bacillus thuringiensis
  unsure (1)...(340): unsure at all n locations
tatactatgggcccnnatcaataaaacttattacaacacaccacacttcaccatattcatatatgacttctttaaacaaatctcccataacaccccaaatctacaaaattataatcattaaaatcaataaaacacctttattttataaatctttaaaaccccacaaatacctaaattttctataacaactaatacatattctttataaaatacttcaaatttcaaacacaaaaaactaaaaacttatccctcctatatacctatatttaaatccttcaacaaccttttcaaaatcctcttaatgataccaacatatattattatacaaccttacactacc

SEQ ID NO: 7227 - DNA, 105 bp, Bacillus thuringiensis
cgagaagtagtaggacatctaacgtttcttgcacaggattgtattcacataactggtgctaaacatctctgatgctggctcgtggaattctgccatttttaaaat

SEQ ID NO: 7228 - DNA, 206 bp, Bacillus thuringiensis
cctaaccttccttttacagggccaaaaacattcaaactaaagggtttcatttaaaggatgcatggggaacaaagtaggacagccccaacaaaacgcaggccaccaagccacaaaccacctccaaaaagtattttagggataaagcataatcgcccgattcctccccaccatgcacactaaaacctaccttccaagtcatgggaaac

SEQ ID NO: 7229 - DNA, 295 bp, Bacillus thuringiensis
taactgaaccctttgatttttttaataaagcagagcttagactggattatccagagtcaaacgaaatacatcaagaatacactgttatatatgaaaggcgcggatgggaacatgcaacgagttttgcgaagtggtagatttttgcgcaggattccacctgcctaaggagattccagaaatgtactctcacgcgagaaccgaactataacccccacctgacgatgcgaaaccccccggcgatcccatggaagatctgttaatcccctttgtttacccaacattccttggagctgta

SEQ ID NO: 7230 - DNA, 157 bp, Bacillus thuringiensis
aaaactattttatttaataccaggattctattcctattcagtgatacccttccccatttcccctggtacctggtatctacagaaattatacctgccatctttagcttacatctcctctgcctgcaagtgaccagttaactgttatccttcacagctg

SEQ ID NO: 7231 - DNA, 103 bp, Bacillus thuringiensis
gagcggaaccaaaaagcccaaaccgaccagccccagaataaaacacaagaacagaccgagccgcggaggggggaagcaacagaccgaaaccagaggccacaga

SEQ ID NO: 7232 - DNA, 407 bp, Bacillus thuringiensis
ttctaatatctcggtccacttctagtcgatattttcctggataaataacttcctcattccccgtacttctatgaactatactgccggacaactgggcttctcctgcggcatgtttggaaaaagaagatcgtaattgtaatggtaaataaactcgtgtgacctgataatcgcccaaataaggcgattgccttacaagcgacatacgctgacccggatacggtggagtgatgtctactcttgtaaccagtactcactattaaacaatcgatactccaacgagaaatggaccacgaaccgcatactcatgctgacggtccactaacactaccaacaccgtcatcttgtccgctggacgggaggtgcccaccagcactatatctcttccatatatgctggcacgtatttag

SEQ ID NO: 7233 - DNA, 173 bp, Bacillus thuringiensis
acacacggttcttcgaagctaaagtttatgtgatttgttgtgatgatttaccaaggcggcgatgcgtactacaataactatccatatatccaacataagctaccatcgttcctagcgtgaacctgacctggaattacttccttatgctagtaaaccaatcacaagttatggac

SEQ ID NO: 7234 - DNA, 364 bp, Bacillus thuringiensis
  unsure (1)...(364): unsure at all n locations
gggtgattaatcgggtagataatgtactttataaacnttaaaaaacgaactacacacttatagcaactttgagatttttaaacaaaaacccccacaacccccatatggtaaagaggaagtgacacttttagctatatattattaaatatctttaataggctctttaaacagttagaatgccttaaattcatataagagatgaagctttgtccatgtgcaatactgatatttagctagaacatactgatcgtagtaagagaaactatacagtaataattattgtaaaaacattttaaaaccagcttgataatttatatgtaaagcatatgtattatacataaatacaaataagactaacgatatt

SEQ ID NO: 7235 - DNA, 221 bp, Bacillus thuringiensis
catatacagactttacatttttcataacacgacaactggcaggggggcttttggatgcggtttccttgcctacgatcacgcctgtttgattacagacgatggactgcagtcgttaaaaacgcttggagtgtatcgcatactcgtctagtcagaaaacttgagaacgcaatatacatgttctaatgctctcacacgcacagtgaaagatcaattgacatgat

SEQ ID NO: 7236 - DNA, 515 bp, Bacillus thuringiensis
aaaagttttaattcgagaagtttatggaaataagaggatttctgttatatgggaagaactttctaatgaagattattactctcttgaaaaagaagggttatcaattgatagaattacattacaaaaactatttattcatataactgggggtgaaataaaatgacgatgttaatgaagcagttgaagttacatataaaatatcagtataaagccattcttatcttttggactgtggcattacttataaaagggacaatgactgcaactgatttaaagggaataaaggtagcatttttacatgatattttcaataattcatcaattgtaatcgtaatgcttattgtgaataagcgtgtttcttattcaacttgatatttttcctacagtcgtctcgtttggtgtcactaggttgcaatttttgattgggtcaatatgttttaatttattgcaatcagcattgttttcatgtcttcagctttgtttttacaggatacattttataaaacagacatgta

SEQ ID NO: 7237 - DNA, 435 bp, Bacillus thuringiensis
tgtacgtaaagtgctcctttttctgaaggctcaactaatacagcatgcgctggtaaagtagagaaatatatttctgatagttatacaacttcgttagactggtcaacgcggtcagaccgagctacagcgatggctgaaccgtctgctggaacaagcgttatgagcaatggaaaccaggtaacgtgaactttcgagagtaaccctgtgcagcagataaaaagacggctggagcatccagcactacgagcagggttgacggtacaccaatcataaacagtgttcaaagttgagatgctactaaacgtactggagataaagggatggcgaacacttggaagtttgccgctagagcgccatcctgaactagcgacccaactagagggcagggattatacacaaaagtcgcgtgggccacttgatgatcctaccttatgc

SEQ ID NO: 7238 - DNA, 270 bp, Bacillus thuringiensis
ggctcagaagcttgacattaactttgatgcaaacgcaataaacgcccacacaacagcacacccgtggggctttgaaggaacgggacgggctgaaaaccaagcgcaaactggacaaattatctgcccgtagggccaacacacgttattcatacggacaagacactcaccttgacacacaaaaacgacactggaatttcggaaaggcacatgcaataaatccacagccatatccaggctggttaatagtatgccaagccttatacttactat

SEQ ID NO: 7239 - DNA, 292 bp, Bacillus thuringiensis
aagtggtgattgatgcctcagtaactttagcctcaccctggataaagtacaggattccctatcaccaggggagggtattatagcacgcttgcccctgactgcccacaacagtttcacaaggtacagagtcacaccttgaggtgtaacaagaggaaacaaaaaagcccacggggtgcattctttcgctgtagtgtgaacacttgcctgagctatagacatgttatgtttggtaacaagtgcagctttatgaaattacggaacggctgtcactttagagaaaccccactcccac

SEQ ID NO: 7240 - DNA, 242 bp, Bacillus thuringiensis
tgctcacgttattaaagctaaagacaatcgaccggacgtggggctattattaaacacaatcggggcaatcaatcatatcttaccgaacgtcgatggaattgtcctcgtacctacaattgaaattttgaacacgaaaaaatcccaagaagaagtggaaatgggacaagaaactacaccttgaatactctaaactgacgtactaatgcaacttacctctattaaccctagaaatatcactagac

SEQ ID NO: 7241 - DNA, 198 bp, Bacillus thuringiensis
aacgtggtgatcgaagccccagaaacagcagccaccccccgaatactaacacaagcccccaccccaccacgggggggcctttgaccgcccccgcgggtagcacccaaacacgaggcagcaagcaacaaacccccacacggcgccctaccaaggaccgccaaaaaagccccgccggcagatacccccgacgccccgagg

SEQ ID NO: 7242 - DNA, 585 bp, Bacillus thuringiensis
tttctttgtggttgacagctcgcgattgctcgccctgtctgagtattagctgagtcagctcggctgtcctggcagatcttcgtcttggcttgaatgtggagtcttttcccattgctccatcctcctcagtttcaagattccgcatatctataaccagagtcacaatattcccaggcaaagtgcttgccgcatagagcacagctctggccttgcaccatggcctcgagcttacccccgctagtctcacagctgtgcgacctcttgcataacccggacctgcctgcacagcttgcctcggctatccagggcaatagtagtggtaacgaacaggacatattcttgaggatagacgcgtcgatcactacgaatgccccatcagactctcattccggggctcatccgttggtatgaaggaacccgcgttcagtcgagctccactgaccttctacctagggatgcatcaatctccgcactggaacactcgtgcctttacaggcgcttacacccgcacatactcctgacccaagggtaggaccagcgcatccttatgtgcagttcaggggtaaataacaactgatgctcgca

SEQ ID NO: 7243 - DNA, 227 bp, Bacillus thuringiensis
aggtcactttctatatgagaaagggaatggaccgctcttgtgtgtattattaacgacgatcgagggcaagaagcgtatcatcattaacgtcggtgacaagatcaccgtactaacatatcaaaccatgattacactcccattcctatcgaatgaggtgcatacgaatatgaatatggcttgcatagggatgacgggtgtactaatggtatttgaagtaatagcacttg

SEQ ID NO: 7244 - DNA, 298 bp, Bacillus thuringiensis
  unsure (1)...(298): unsure at all n locations
ctcagaagcttgnctcgtattatatttagcgattattatatttagaaggcaccccccacacgggggggttttatttattaacatgggtctggcacaccaccaagtatcttttagcaccatccccacatgtcattataaggatgctggtgataacgcctgtctcatccatctataatgaatgacggcgggaagtgcccgggagtgtagattttgaccccattataccaaaccggtgttgctggcttgttaggagcaatgattggtctcgaaagaaaaattcgatcgacccaagctgaat

SEQ ID NO: 7245 - DNA, 299 bp, Bacillus thuringiensis
cgatgcatctgtagcgctagtcacacgctgttgtatagcaaaggatgtaccatctacagggggggtgactttaacacgatagccggtgtcagcctcctacgacggtttatcatacagagtcttacctggtgctgtctcaagtgctgacaaaggagcaacgagattgctttgttctgccgttgacagtgcatcagcctgagctctagacacactcagtgctgtatcacgagcggcatgaacaaattccacatggtatatgactatatagaaatgcacagtcacatggacagcacggacat

SEQ ID NO: 7246 - DNA, 145 bp, Bacillus thuringiensis
  unsure (1)...(145): unsure at all n locations
atgccgtnaatgaggctgcacctaacataaatgaanggagggtctaaaatgactatggggttgaaacactgctatgagaagatctctattaattcatccgatccagcagtacgattagctggcttagaatccgcggtagacatat

SEQ ID NO: 7247 - DNA, 132 bp, Bacillus thuringiensis
ccatcaacgagagggctttgaagttttgcaacagcgaccgcagctgcccacgagactgcgacttaactaggcaatccgaacctaactgctgaccaaaaagtccagattggtacacaacttgaaggacatcct

SEQ ID NO: 7248 - DNA, 244 bp, Bacillus thuringiensis
cattcacataagatttggtagggaacccgcatattattagactactggatcactcgccactgggggttcttttgccaaatactccgctgttacacatacacgatcaggaagccatgagaccattacgttgagctgttctaagaacgtatgatcagagccgcacaacactgtcttctgacgccctgagtccgtcaacctgatctgtatacccaccatgtgttttgcccagagctggacgaacaaa

SEQ ID NO: 7249 - DNA, 381 bp, Bacillus thuringiensis
tgatgcactttgcaactatagcaccggagtcgtaatatagccaagggtctaccctctccagggggggtgagtatagcacgctcgccgctgtcagccttcaacgatgcttcatcatccagagtcttaccttgtggtgtatcaagagcagacgaaatagcaaccgggttgctttcttccgctgatgtacggacatgtacctgagctctagacacacccagtttcgtataacgcgcgcctcgatcaaatctcgcgtggaatcacactttatagtaaactactttcacatgaacagtacgatcattatccagaaacttcactgaatcaggagttaagtcggtataattccatgcagcgtctagtctaggctacaaaccaagatga

SEQ ID NO: 7250 - DNA, 190 bp, Bacillus thuringiensis
ccagaattcggattggccttgcttcactaattttcattactgtcctcgactcatcactccgaaacctgggggagtttaaacctcttgtcgggtcattgcccccattgcaccatctaatattaaaatgatattttccaactttacctcctaagcacctcaataactaaccccttgtcttaccgcttgcttc

SEQ ID NO: 7251 - DNA, 135 bp, Bacillus thuringiensis
ctttctcgacaataggtccaacgctacgagacgccacacctttgtttttattgaggaagtgcacctgttttcactacaatagatcagttttctaataagctaaaatctcggaagataaatcccactttttgtcaa

SEQ ID NO: 7252 - DNA, 304 bp, Bacillus thuringiensis
gcagcacaaacatttccacgatcgggggcctttataggaaaaataatgacatcatcatactccggcgcatcatgaatggaaatggcaacggaggtctcgataacacgcaccatccgtgctagatgggcaacttcttcagacgcaagaaaatctggaggagcaccaagcaaactgggatctgtatgcacagccagatgctcacacatatcattgcgtactagtgcattgtaatcacgcggacacaggcactgtctatgcaccagctaaaaatgtagctcgaacaggggtgtgcccaattaaagta

SEQ ID NO: 7253 - DNA, 100 bp, Bacillus thuringiensis
ctctagatgtaggacctgaggttttttttcaagccctacgggaggcggccttggatgaccctacaataattgtacccgtgcaaaaagaaatgaatatcgc

SEQ ID NO: 7254 - DNA, 408 bp, Bacillus thuringiensis
acggacgttgctctacttcacgattcttatacaggaacggggggttgttgggaacgataagggggcactcatgattctaccctccaatttagcccaagacactcttatgacgggccggtcggatctagtgaaaatggcgcatcatatgaggctacaggagatgaactgggctctctaggtgctgaatctagtgggtgtatgcgtcattcagctgcctaatgctaagttggaacactaaaaccaacctatgatacacgtacccagatacggatttgctgcatttcgataaaagcttgaccacatttgtccgtatacacgttctgattaccacattgcttccttcgtacacgcttagtcaagattagtccggatggatgctacttctggagacgcggaagatgggaacta

SEQ ID NO: 7255 - DNA, 241 bp, Bacillus thuringiensis
ttcgtgattgatgccgacgcaaggtcagcaccgacacccctgataatagaagccaagctcgcaccacgagggggggctataaggctaacacgggtgtcagcaacccaaaacatcgcaacaagggaatacttacctcatggtatattgagaaagaacgagctccaacccctgctggaagattcagctcatgaacggaagcaaacatgtgctaataaaaaccagtgatattgggaaagcgcgc

SEQ ID NO: 7256 - DNA, 220 bp, Bacillus thuringiensis
aaagacggatgcaattgagaggacaagcacgaacaacgccgaacaaagagagatcaaaaaaggagacgccagagaaacagacatcaacgccaacgcaaaagcaccagaagccaattccaaggccggcaaaaacgcacaaaacagcgcacaaagaacccacgtcacaggagaccccgcgaaaaaaaccaaccccaggacccacgaaaaccgtacacaaaac

SEQ ID NO: 7257 - DNA, 305 bp, Bacillus thuringiensis
cgatgcaccctgctgcgccagtcacccgccctgatataacaaaaggtgaaccctctccagggggggtgcctttaccacgtacgccgccgtcacccatacacgatggggcatcaatcaaagccttaccttgtgctgtctcaagaacgcacgaacgaggccccaggtcgccttcttctgtcgccctcagtgcatgtacctgatctctagacacactctgtgcagtgacacgagcgccacgatcaaatcccacatcgactacagatgtctttcgaaaaccactgttgcatggaccgcacgcacatgct

SEQ ID NO: 7258 - DNA, 201 bp, Bacillus thuringiensis
aaaagtggggagcttttacacatcccaatcaatcattttccggacgcacaggcaatttttgccgattaaaggcgttgcactagatattggcgaaggcacagatcggcgatagcagtggagtaagatagttatgaacgaatcttgctagcttgggaatgcctaggtaggatgcactgcttctttttgagatggaagagaggt

SEQ ID NO: 7259 - DNA, 166 bp, Bacillus thuringiensis
cacgcatgttttatgttcgcctcaaactatggatgtattctggttgtttagaggagtacgagggcctagaaatgatagtaacaatggtaaggaaaaaataacaaccctcgggaaagacccgcggcgttttttttttttttaactatcctggggtaaagattgtagt

SEQ ID NO: 7260 - DNA, 240 bp, Bacillus thuringiensis
tacagatttagagcatttgtttttggtttgatgaagtatgagtagttgaccgcgtatacatacaacaaatgaaatcatcactcatcatcctagaagacatcacagacaatcttcttattatagtatcaccacaaatagtagtatggtggtttaaacaaccaacaggtttaccacctcaaaaaactgcaataggaggcggctcgataaaaagggggccaccaatgtggttgagcatccccc

SEQ ID NO: 7261 - DNA, 238 bp, Bacillus thuringiensis
agaagctcgacgactaatacagatcctatccattatttttcaaacgatgcgaactacgccactcgggggtatttcttatatccgaccgccgtagacaccactaccacaactgaacccaaacaatgactcatgcccatgaaaacgatgaagcacctgtagtcaatgaacgcgaaaatacgggaagaagccctatattctctcccacaacagttacaaacagactattccccccctatac

SEQ ID NO: 7262 - DNA, 276 bp, Bacillus thuringiensis
tgttgccccacactttagatcgacccaatgtttttttcctgcctatgagaaaggaatatactttggttctcctaaacattagttcgcagcactacatgaaatcgctctgagtgaacagtgcttcacggtgcgcttataacttcagcccactatgtggcgatgctgctatctgactcctatcatatgctgcacctgacaatgcgctacggtttgactcaagaatggcgcatccttctcataatttattcggcattaaccttcagccagatttgtgag

SEQ ID NO: 7263 - DNA, 291 bp, Bacillus thuringiensis
attcgtgattggcagctccgtcttctctatagagacggatataatatgcaggtaccaacctgacaaaggagggggatctaaaggaccaaggctccggatatacactatagcccgcatgcaattcaggatcgtacgacagagtatcgcagcctaaaacgcctttaggccagcaactgagggggcccgatgccgcagccactgaattctatagtgccagcacgctggacgtcaaattcacgggtggcctaattacaacgaagtgtgtggaaagtcccacggagcgcacaggct

SEQ ID NO: 7264 - DNA, 357 bp, Bacillus thuringiensis
taaggctggttatatggctaacaacccattttctatcttgacaatcaaatcgtatcattgggatgggggcgagcaaaaagggatgttctaatcattacaattgcataactctctgctagctgaatgatagtaaacgatggatcgttcctattggcaccatctgacgattttctctaccctgctggaataacagatgccttcactgcattccaaaaagtactatctttccacagagacacattacattaacgtcgccagttgaacttgaactggtaggcatatgaaaagatcctactaccttctttatcttggggacataccatatgttcctgatccattataggacacatcttttat

SEQ ID NO: 7265 - DNA, 242 bp, Bacillus thuringiensis
gatgaagacttaagcgttttcagtaataaattctccattttaattaccttctattaccccaacaaagaggtggaggttagtattatctcctacaggtgcttcagaaaaaacaatataaggatatgaatacaatttttcatcagttgtactacaatttacacggatcgtataaatatttatgaacagtagcactagcaaaatacaaaccattttttaaagaactagaactttcttgcttaaag

SEQ ID NO: 7266 - DNA, 220 bp, Bacillus thuringiensis
gatctgaatactaatttaattgggcatactcaatactaagacgctatgtatatgaaaaaagtaggtgattgtgcaatgtaatttcacattgctctacctactaggactttatcacagtcttatatcctatcctacaactcccaagttaatatgcatatgtgcagatgactagcttattggctacccatccgcggctatgttccggtccaatcattgctac

SEQ ID NO: 7267 - DNA, 292 bp, Bacillus thuringiensis
catgcccccatttggcagtcagccgctctgatatacgaaacgacgctccctccccactggagtgtcctttaacgcagacggcggtgtcacacacacacgcgcgcgaatccatcaaacccttacgttgcggtgtttcaagaacatacgaaggaggcccaacaaccgaagctaccgccgccccaagaccagaaacctgaaccgaagacacactgagagatatgtcccgcgcggcacaaacaaacctgagcacaaagaagagactttcgacaacaaatgacaggtggaccgcacg

SEQ ID NO: 7268 - DNA, 155 bp, Bacillus thuringiensis
cttttatttttataaaccagaacacaactcgggggggggtctacggctaaaaccggaacctccccttcaaataaggttcatatcaccccaaggatgaccgtatacgctcgcagacaaaataaatacgcaaagagattatcaaaaatgaccttcaa

SEQ ID NO: 7269 - DNA, 345 bp, Bacillus thuringiensis
ccgacggggacggtagggaccaaaaccaagaccaactcatcctacgggaaagcctaagtgagtcgcagccttaattagagacgctgataagttacaccaaggtcctacgaacagaggatgagtaagaccaaccgttccataagacaccattatagctacatcgacccacgaattcatgagcatgatagaagaacggcgagtgcttaatactctgaatgaaagatccacaaaacgtgacgaatggatcatttaatgcagcaaacattgcatgaatggccatgcccattgaaacaatgcgacgcgggcttaaagctgagttccaggaaaaccgataaacgagataac

SEQ ID NO: 7270 - DNA, 426 bp, Bacillus thuringiensis
cggcgaagagtgtattatccaggcctacatacctttgtttttgaaatgtatcgagtgtacagacagctggcggctcatatcaaattcaaagatactaagtggtataactgagctagatattgctaagccgcggtggaggatacttatggggttcatgtgaacatacgagttctgtaagtaccaggtcacgtcgttctgcacgcaccggcatcttggactgttattgaggaccatcctcgtgacagactccatagccttttataccaggcggccagtgagctaactagtttcgctcttacaacatttgaagggcatttttgaaggctgttgatacagtgttcggtatggcaagggtatatggggctgtaaccaagggcattgataccgaactatgtcgacgacgctgaacgacggccactaaaaaat

SEQ ID NO: 7271 - DNA, 226 bp, Bacillus thuringiensis
  unsure (1)...(226): unsure at all n locations
gcgagaagcnagcgacaattcanatacacacaccagnatantactcactcaacaaccactatacgatgtcctatgaatgcaggtgacacaggactcgcgatacgcctactaaagaaaggcggaacacactctaatcaagccgaaacataacactacccaaagagttggccgacttgaccagatagctcgcaagctgatagcgaggaacacgaagaaataaaccccg

SEQ ID NO: 7272 - DNA, 312 bp, Bacillus thuringiensis
tattaccccaccatattgcccccacccccgaaccaacgccagggggacctttaaactgacatgcggtgaaaaaaattgataactgaaagtgctccggatacaaatctcatgaactaaaggaacgcacactcatggcacctaaatcaccaggctaccgcaaaaagccacacgcaaaaacgacaaaaaaagacttccggaaccgttgtcacgagcaaataacaaagcgggtacttgacctcggtttcccgcgacccgaatcacaagatacgaaaaaaaccattcgataacccccgcaacacggcatcataaatc

SEQ ID NO: 7273 - DNA, 209 bp, Bacillus thuringiensis
ttcgtgattgatgccgctgcattgtcagcacggaaaccccggatattaacagagatgcactcaccaccatggggggctgtaaggcgaacaacggtgtcagccacacaaactagcgcaaaaagggaggaattacctcatggtgtatcacggacagacgagctaggaacccagtcggaaggtacagctcccgcacgggcgcaaacagggac

SEQ ID NO: 7274 - DNA, 289 bp, Bacillus thuringiensis
tggttgccctgacttatctgtatgcaaaccctgttaatgaagcgacaggccggcctcataatgggggcctgaaaaccagaagcaggtctttcacacataagcgttatctccaattgaggtattgcggcagcgtatctcaggataaaacaacgtctgcatctaaacggaggttacagttctcgcagcggggcacttctggaccaatcacatactgtgcgtaatatcccgcgctacactaacaacaatgtgctgattgaagagacccatgtaaaacagtgacatgttgact

SEQ ID NO: 7275 - DNA, 238 bp, Bacillus thuringiensis
  unsure (1)...(238): unsure at all n locations
aagcnngcgacgattttagatttagcacataataagtaacgaccacacgcgaaagatatatacagttgtttatgatggaaacctactggtcacattgcatggcaaccaagaaaatatacaaatagtagaaccatactggaaatctgttctgatacaagattatatgttagctttaccacagtctttacaaattgagttttcagatggatttgtttggtaggacatagagagagggaaa

SEQ ID NO: 7276 - DNA, 185 bp, Bacillus thuringiensis
aggaccgtgttaccaaccacccacaaacacaggaggggggtttatgagaacaggcgagcaaaaagccaaccaaaggtcaaggaaccccataaaagaccacgagcttgacacctactaatacggttaccaacggcaacacagagcatcacaaacaattaaaccggaaaacaactgacgctaaaccc

SEQ ID NO: 7277 - DNA, 248 bp, Bacillus thuringiensis
tcggattgatgccgctgcaatttcagcctggacacccctaataataacagacaccccatcaccaccacagtgaggtatatcacgcacgccgcggtcagccacccaccctaccgcatctagcagaggcataccttgtggggtaccaagagcaaacgagctagcgaccgggtcggcagctacagctcgcgtatggacatatacctgtgctcaagacacccactgctctgtagaaagcgcgccacaaacaa

SEQ ID NO: 7278 - DNA, 390 bp, Bacillus thuringiensis
attcgtgatcgacgcaagattgtccaccgtggacaggccgtatactttcagaagtaacaaccatacacgcggggggcttttgcaacggactccggtggcacatacacactatttcacatctaacttggctagaagttgcaaaataatcagaaggctccatcaagcctgtaagacagaatccatagcccacatattacaaggtaggagctcactctgcaacacctgcgtattgaaatgggccaacagcctaattctctactctatacagagtttgcttcaatccaccattgcatgtaccacatgcttattctaacaatgccttcactacagttggagcttgctgctaacttaccgtgcagcgtgcagttacccgcatccatcctttagtaa

SEQ ID NO: 7279 - DNA, 424 bp, Bacillus thuringiensis
caccatttattgttttggcccacaggacattatatcgacaagccttcaaacaactagataatgtacaaaatgcaaagcaattatcagtgctcgcttcacggacctgtgccaatcgtgcgaaagactacactgcatttacgttgtcttacgcgtgaacttcatgctttaagcatagtaataagaatgattacgacggaatatatctgaatgaacttgttatacatctagagatgactcgtacttatatgtctaaactgtataacgaggaaatgggactcgctactagtgaatatattcaaagggtactagtgaaagcagcacagaagctgtcttcactcactacttattggatatcagatatcggtgctcggcttaactttaatgaccacaggtagtgatacgagtctcaagaaaatgctacatg

SEQ ID NO: 7280 - DNA, 364 bp, Bacillus thuringiensis
ccaccgacgtccgctgtttaagaagatgacttgtgcggactgtacgacgcatcccctgtgctgacggctccggaaacctcggcgcctcctataccgagccagcctccagcggcaatcccgccgccgactccattgagcaaccgtgcatctttggacgtcccgagggcacaacctgctgtacgaaggtccatggatgtaggccgtccatccatggaccaaggtttcattgctatggatctggacttagctgagggcacgctgtggtgggctcagccgaacgttcctacccctgtccttcagaatcggcaggatatccttcttgagttcgaagagtctagctcttcgaagcgaggcgggaagacta

SEQ ID NO: 7281 - DNA, 110 bp, Bacillus thuringiensis
tcccgggctccgaggctcgtcaccaattcattacggccatttacattttcacggaataacccaagacagagggtgggttcactaagccaggatggggtcataaaccacat

SEQ ID NO: 7282 - DNA, 110 bp, Bacillus thuringiensis
aattcggataataacaggaatgcaaaaaaggcggaatcttttcgctttaaacttctccttcgacggctggtttgaacgggctcaccaacacattcggtggactggccgac

SEQ ID NO: 7283 - DNA, 135 bp, Bacillus thuringiensis
gaacatattggcgaaatttgactgctgtgttaatgacacgttacgttagatatgtcaaaactctttaacatatttgtgaatccctgcactgcgtcatgaacgtgttttaatgctgttgtctgaacagtatacata

SEQ ID NO: 7284 - DNA, 146 bp, Bacillus thuringiensis
gatcctcggctattattcactcttaaccagacggaatataattttattatcgcaaccagctaacgctgactcgcctgtatgaaatccatccagggggacgcaaatattgaggtaccgcctggattcaccgtgaatacaaccttttg

SEQ ID NO: 7285 - DNA, 225 bp, Bacillus thuringiensis
gctcggagctcgcacaattcatataggatcatgtttatgtctgccccaagcccatggcgggggagtttaagagaaaagggtgcgaagacttgtgcacgccacatccgacacctattctgcgagcccttccaaaactgtgcaacctatatgatttgcccaagctgtaaatcagcggtgtccagccgaccgcgggagaagaccactaggtcgctccttcccacgact

SEQ ID NO: 7286 - DNA, 197 bp, Bacillus thuringiensis
tgttaatcgcaaagaacgctgtactgaacactgtctactattatttcgaagtgacggagcttctctcatagtcagaaagaaaattcttattatattcaggaagggcgtccagctggcatgaagcttggaatacgaacccctgatacaacccaacctgtgaagaaattacaggttgagctaatgaataaaggaatgtt

SEQ ID NO: 7287 - DNA, 107 bp, Bacillus thuringiensis
ctcggaaagcttttttggccaaaaatgaaacataaccctcagggggcattattgcacaatctcgtgcgttatatacaagaccaaaatcaggacgcgacacacacgct

SEQ ID NO: 7288 - DNA, 393 bp, Bacillus thuringiensis
atccgtatttacagttatggatatctcctaattacatatgaaaaagagagaggaacattggctaggtcttctctctttggttatttttaagataactatctataaaattctgctttacatcattgttcatgagtctggataggaatctactcctttcctagactcaatgataccggtctctactgtacatcctgaccgcggcttaaatccacttagctgttacatccagtaccaagcttactgttggcgggctactccttcttgaaaaaggttctctactatgattatgttgtctctccctgacctcagggcactggtcatgactttagtggacgctctcaccttttatttttcaatatactagacctcgattgattcgcaaaaccctttctg

SEQ ID NO: 7289 - DNA, 182 bp, Bacillus thuringiensis
tttttttatcgtaagcgctctcgtactgaggggcgtttctggatctgcactcgttcccttatacatgatcggaataagctcgtgaattcattcacagtgatcccaatatatatgttactctattccaacctacaataaaagccaccaacctattaattttttgaagctattccctccatcta

SEQ ID NO: 7290 - DNA, 153 bp, Bacillus thuringiensis
agatacaattttctctcccgaatgaggtcgctaccagaggaggggtattttaaatattctgcggttacaacagcaagcatattattcccccacgattattgatttattccacccgctgcgcgtggaggaccagcttcttaccacccataccaa

SEQ ID NO: 7291 - DNA, 134 bp, Bacillus thuringiensis
ccatactgctggtttattgactgtaaaaccaggagaaagaactgatatggtatccaattgacactaaccaaggcgttccgtaaagggctctgacaatacgtaactgttggttacatgctttggtgaaagcactc

SEQ ID NO: 7292 - DNA, 358 bp, Bacillus thuringiensis
agatcacccttttaatatgctcctcattattacagcacggggggggttacattcaaagggggttgcataacaaatacactttatgacaccagacgactcacaaattacaaggttattcccccacccagtttacttacgtaaatcccataagcctttctcaaacagcaccactgtctacatacttatatcacactttaattgtcttcacagtcgtcacgattggacaccttatcctctcaagtttagcacctcatgctttccttccacttcagcttaaagggagacacttaacttttcttcctgcctaattcaacgatgctatttccctcgcaagcaacgttggtacctaactttttaa

SEQ ID NO: 7293 - DNA, 235 bp, Bacillus thuringiensis
atgggactccacatggaaagaggggtggtttggtgactttccgggaatgaattatgatggatcactaaactcagagaatgataaaggagtgatcagaccagggacggaaactcaagatgatattcacgggcttactgatacaggcagcgaaataacagatgactagcgatctgacagtcgaaacgtcctatatgatttctgttaccaataaacaccggtttggggtccgtatgaa

SEQ ID NO: 7294 - DNA, 186 bp, Bacillus thuringiensis
attttcataatataaaaaccccctctaacttttatagtgggacataattgttccacctcttagtatgcatatatatatacatttgctggtattagcaccgtctcaaacatttcatttgaaggttgttcatttatatcaaattcttttctttttaacattatatttaatataaaattattttacatt

SEQ ID NO: 7295 - DNA, 262 bp, Bacillus thuringiensis
gaaactggcattaaaccaacgggtgggaactaacttggtgtcgatgctacacatgacgagcgatatggccatgaagggatagtaacctgataactaaaggacgtcggtgatctcagtgacggcagacctggttgcagagatatacatgtacacttcccaggcaatggaggaccgagctacggggaaggaacatcaagtaccgaaggaggaaaaaccggcccctgacggatctattgccacaatgatacacagcaggaatgac

SEQ ID NO: 7296 - DNA, 136 bp, Bacillus thuringiensis
gatcattggatccacctgtttgaatgacaccctctccaacataaagaagcggacgctctggggctgaaattgctctagccgcggctctaagcttcatgctgtctggtacacgacgcggctcgcacccccgaacata

SEQ ID NO: 7297 - DNA, 547 bp, Bacillus thuringiensis
gacagcagtgttcctgtctcagatggcgaattgtcagttcctgtaggtatgccgaccgggtcatcactggcatactgtcagtcatccataagtcgatccccagagagagtatataagcttgtttgcgccagtggaaacttcactagcgagccatgtagctcagacctcaggcaaagacctggggtacagactcaattgaccacctccggctccgaatatcggggcagtctacatgccgtcacttacactctctacctgcgaccagaacagtatgaggaccgttgatcggtacgccatggcccgcaccccacgataggagccccgtttctgcatcgcgagagcgtctgtggcatcgaagagaaagagctcaacattccttttcgagttaatgactgttggcggcctccttgacggctcctaacttgcgtcttgagccgccgatgtacatctgcatgtattacctcgacggattgattgatgcagaggactcgattaccctgcactccgttcactacaacggcagttgtctaccaggatgtacaatata

SEQ ID NO: 7298 - DNA, 348 bp, Bacillus thuringiensis
cgacgcagcgataacggccgtcaacaggcctaataaaagaaaaagtaacaccactccagcgggggggcttttgccaagtactgcgccgacaatgatacacgatgtctcatctagctaagcggaaacttgaacagtgataagaacgcaccaacaaggctccggggccgcatctatcgttcccatcagaccagggaggagaaccacctacgcccgatgcggagtgagacgtgcgaccctagcacatctcactgcgaatcagagtgtgccgaacaccacacatacatgaaccccaggctcatgctaagagagcctcacctacacatgtggctcctaggaaacataccgagc

SEQ ID NO: 7299 - DNA, 144 bp, Bacillus thuringiensis
ttcgtgattgatgcatctacaattttagcaaggagaccgctaataataaaaggaatcctcacaccagcagagtgttgtattttacgaccaagagggttagtaatacaaaataccgcataaaggagagaattaccttgcggggta

SEQ ID NO: 7300 - DNA, 128 bp, Bacillus thuringiensis
caaaaaacctgtcgagccagggggcggtttaaattacacagggggcggagaaaggctgcttgcacattgccctactcttccggtatctcgattactgaaatcataccctcgtacggacagataccgct

SEQ ID NO: 7301 - DNA, 387 bp, Bacillus thuringiensis
tgtcgtggtcgagactgttatcggcggagttctggagcggagtttgtgcacggaccaacccggacaacgcctttgcaggcttttcgtctcttctattacttttccactccacttcatcctcactcattacattaagcctgaaatgtctgactcagaaacaccacaattcgaatacgtgacccttgtatccggtgacggattcgagttcattgtccctcggagcacagcctgcgtttcaggcacgatacgccggatgctcgacccttcgagtcagagccccgtctttgctatacctctgcctcagagagaaaaaaagataagctaaccatttttctggaataggcaagttctcagaagcgttaacgggccgatgcgtcttccaaggct

SEQ ID NO: 7302 - DNA, 167 bp, Bacillus thuringiensis
tttactagttgtattgtaattcaatcatttatagccaaaacttctcgctcctgctgagtgacttttaaaaaagacacgccttatataaactgaacccaaaaaattagacaccaaaattacttcaccatcctaaatcatctacacccaaaatccaaccccttcacccc

SEQ ID NO: 7303 - DNA, 155 bp, Bacillus thuringiensis
gaaattttgtctatccaaggaactaggtcacttagaggggataaattaagacaccgggcggtagtaacacgcgaaaaccaagtcggcacgcaggataaatgaattacaccacccggcgcagagagtcgagaccagcgatttgacaaccggaccga

SEQ ID NO: 7304 - DNA, 327 bp, Bacillus thuringiensis
agattatgtcatcgagacgtgacgtacgtgccgcctaacatggaatgacgctaatgtgacatgtgattagccccgacacggatataaagataccaagcgccatcctttggtagaaaatgaactcacttttactgaacctaccatcgttacaatgggctacgtgttcttttctttcagattcctgaagtggctgtacgtagttaaatacctgctgatactgaggaagcggcgggaagttgtctttacaatcgaagttaaaaggaaggaccgaaacgtattgttggcgggccatttatgagctaaacacatttttaacgagagagtatt

SEQ ID NO: 7305 - DNA, 375 bp, Bacillus thuringiensis
tatcagatgttcttttttctgccaagtgtagcgacatcggggtgggttgaaaaacaaaaacgggggtaaacaatatatgaatgattctgaaataatagatattcaaaatacgctatttctttctattgctgacgcgtaggattggatagatgaagaagttcatgtattgctccgttccgacgtaccacataacaatcaagcgtgtgtagaagaaaaatgggttaaccaaacacagccagtattagagacggaaactacatctgtgagtcaaatctctgctctatacctagtgtagccgagctcggaactgattttccctgtcctcctttatacattctctcatgccctgtatgttgtaatttaccagacgatact

SEQ ID NO: 7306 - DNA, 133 bp, Bacillus thuringiensis
cgtgatgagtgaaatagaaattgggaaaattacaacatcctctggaccgaatggatgtgggaaatcagcgggactttttagaatgtgtagaaaccacactcctagcagtggagaagtaaaaacttgatgggaa

SEQ ID NO: 7307 - DNA, 155 bp, Bacillus thuringiensis
taaagtttgttttatatggcgagcatacaacagaggggttgtaccacttactcgggcgatagaatgtctatcatcagctggagttcgtgcagtcactatgctatgacgatcaacgcattaaggagcataagaaccacaaagtgctttggacagcc

SEQ ID NO: 7308 - DNA, 501 bp, Bacillus thuringiensis
ccactggtttgaaccgctctcgagtggtccgtaattgagctcgggtcgtgcgggagcgtgaatgctgctggggttgagataagtactttagagcgcgagaggcactgttggagcttttcttgaacactcgacatgggcatcgtctccgataggttgacttgatgtggaagacttctaatgttccaaggccttggaagttcaattacaactcttaggtgataaattgaattcactaggaaagattatctcataggccccataccctccaatatcccatacaacctatacctagctcgtcccttgaagattgcttctatgtagtcttccgcatgggcggcacaagctttaacttcgtgagatctctaatcgcggtccgagcactctcaaacgagtctacagttcctagaaaccccatccggctcgtcttacgcatgctcaacgagagcgcccacccacctaggaccgtcgagtctgtcatgccgaagatctgggcgcggtact

SEQ ID NO: 7309 - DNA, 337 bp, Bacillus thuringiensis
atgttagcggttgtacagatctgcgttctacaattgacaatagggataggttgtgtgcatgagacgagtattagacctacagcggtaggaactcagggagagcacaaagggtttcttgcaaagggggcagttagcttaaatgagacagttgcaacactataccacgggcgtacgtgagacaattgcgaaacttaaagaaatgtagcggagactgggatgatgacacacttaaatgcacgttttatgtgctctgaggcggcacatatgcagacgctaattcatgaagggcacaagcaacatggtgggtacactgagaagccaccagcagtggaaccgt

SEQ ID NO: 7310 - DNA, 196 bp, Bacillus thuringiensis
atagagaggacttataaccgatgcaaaaaataccgcaaaagggaaattttaagcaagcaggggatgggtaacaaccagaaaaacaaaataggaaaggcaaagagagttgatacaattccacaggcggggaaaagaatcgaaaagccgaatcgaaggcataataacaaaataaagtagctaatggatactgataaat

SEQ ID NO: 7311 - DNA, 511 bp, Bacillus thuringiensis
attcgtgattggggcggaactacagctgcggaaacaactctcttttccaacagaagacgggcagaataacgtcctgttatcattagaccaaactttgctaatacggaaacaatcgctggggcatgaatatccatatctggctcaatagccgtcccattatctatcacaatgccacgagcaacatttccttcacgcccttcctgtgacgacagcaaatgcacttgcattcacagcaccaagtgcatgatgtacgtttagccactacacgtaattacttctcccctgagagcaccctgcgctcctacgctggctaacaagataaacattgaaaggatgactcacggttactaactattcttcgaaaagaaagacactatttgtagtactacggacggacactacatcaatctctaatgggcgaatgtttaattcttatagaaacgctgctactattaccatataaatatgctgatcactgttcgaccgtttcagctgattaatcttacattgc

SEQ ID NO: 7312 - DNA, 320 bp, Bacillus thuringiensis
catagggctatttttctttgcattatcgctctgtcgcactgggggacttgctataaaaaaatgtgtgtactcattgtgaataagtgcatattttggactctgcgtgtgtcgcttgagtgactagtgaaaccatataaattcggtcaacagagttggcgcttttagtcataccagcagactcgacgggaatgatatttggggatacaggatcactaaatgtacagcttttgctagcaagttgggatgtgattaaaagaaaaaacgagcatttgattgaactacgactgtgcagaattaacctgtatctgatattctatggt

SEQ ID NO: 7313 - DNA, 294 bp, Bacillus thuringiensis
atttcagcaagtggttgtgtcacgccgaaactagcatagtggacgatgatatttgtgagatctgcacggtcaaccacgacaggagaagcttatagagtaaccatgacatgaactgcctgcaatgtaagaaacattctattcaaactgtaaataatagatgacatgttcaattactgaatgcattcgtactatcatatagcgaagtacacccgccttcttttataaatagaggaaaggaatggagcggaacgatttatgctttgttcatattggaaagccattcgataaaagagg

SEQ ID NO: 7314 - DNA, 102 bp, Bacillus thuringiensis
aaattgtctctttccaccgctaaatcaattaagatggctttgcaacatggatgggggactaaagaagtcgagtggtctgagacatcaccatgcacggtcaga

SEQ ID NO: 7315 - DNA, 233 bp, Bacillus thuringiensis
gttgggagaatactgattgagcgaggatgatcactaaagaattgccagtcataaaatgtacaggtggatgaagtcttgcacataaatatagcacaaatccaagtgattcattacaagtgaatgattatttgataagcatgattttcgcctagaagatttatgtgcagctgctactttaactaagaagcttggtatcctttctaatccaggtcctaccttaaatactatacttt

SEQ ID NO: 7316 - DNA, 335 bp, Bacillus thuringiensis
ccaaagcgcacaatgctatggaggccaaataaaaacattcatgaaggccatgacacacggagcgcacggacaggacagacactaaaatgatacctacaagcacgccacatagtaaaaacctcatgaacaacattcacactattgatcggaatcagaaaggaaacaacgccaaaccaagtcgcacatgcataacaaaaacgtgaccatttctacaccgacgggaaaactacgcttgcaacagaaatccagggtgcccgataataagcacacttgggaacgacagataggactacacacagctgggatgaggagaaccccgtcagctacgagcaagc

SEQ ID NO: 7317 - DNA, 407 bp, Bacillus thuringiensis
ccttactagctaccatatactattgaattgtactccccacttgctgagctgaaactggagaggcttttataaaaagccgggggtaaaaccattgcttagctataaaaccacgaaagtcctgcgtttcactacaacatattaaaagcctgactactacaatttgccattctaccacgttgatggcactgtatgcaatataaccaagtatagactatacctgagaacacagtgtttttcacgcagccttgtaaagtccgaatgtcagcaggagcctttgcaactgaagagccctgccattgtcaataggggaacttgcgacgctagatgcactgaacatcagaagcaaccagattcaagcgcttacagactatattgggaatttttcaaagctacttgagtttcatgct

SEQ ID NO: 7318 - DNA, 154 bp, Bacillus thuringiensis
gcactaacgcatgtacgaacacgcgagcagaggcgcacaaaagggccggcaaccgtgcaaaggccgggtagctgactaactgccctaggatcccccccagtgacgagcgtcatcatggtcctcgctggagtcagtgctggtgagtacagacagg

SEQ ID NO: 7319 - DNA, 178 bp, Bacillus thuringiensis
ataacagtgaaattgtgaagaataattgggtaattcctaatactggtgggagcggaacaacaattttttacgtaattggtattatgctaatgttcggtgtgctatatttctgctcgaaaaatcgtatattatgaactgattttatagagctagactgattgttgcgttcgagagtttt

SEQ ID NO: 7320 - DNA, 155 bp, Bacillus thuringiensis
agaaaaacttttatctccagaaaaaggccactcccatgggagggattaattaacttaggggccgttacaaaccaaacacaattagacgcctccgcaacatgagataaaccatacaccccccaaagaagaccagcatcttaccaatcgaagctcca

SEQ ID NO: 7321 - DNA, 275 bp, Bacillus thuringiensis
gctggattatttatgaatgacatggtcaatatgcggttgggcttggctgaagattgtaaaagggcccgaccgcttcctgatttgccggttgcggcactctgattgtgtactaccgcaacttgtctatgcacagacaagtccgacgatgagaccgacgcttggggctctccaggaaacaatgacgtgaacacacatagtgaagcatgatcacatgatttacgatccttcctagatgatctggcacgtctaaaaacatgagacaggcctattagtgc

SEQ ID NO: 7322 - DNA, 146 bp, Bacillus thuringiensis
gaggcaacgcgcgaccatttatcgcacaaccaatgctcatactgtaccgcgcgctaatgcggcatacagcacaagggacatcgtcttaaaactgcaactgacaagaacgcccaaatgcaaccaggccttccattgaaaccacatac

SEQ ID NO: 7323 - DNA, 292 bp, Bacillus thuringiensis
ctgaaaaggacctagaacctatgcaattaaaatcgcttagggggaatttttggcatgcatgggatcagaatcgaccaggtaaccgtattagtctcggaatagaaactcgatatcatatgtaaggaggtgaaagagaccgccaagctgaactgaaggccgcatcaagtaataggggagttaatggaaacgagcagcataccaatacctacagataaaacgcaccgagcaagaaacgggaaacaacgacctcataaaatgacttatcaagggcgtgaccagtgcattaaacaac

SEQ ID NO: 7324 - DNA, 292 bp, Bacillus thuringiensis
attcgtgatggagcatgtgttaatagacaaacaaagtcttttatttagatgcaaagtgatctatgtgatagaggacttggtttgaattcagctgtgcacaattgtaacgtctgtaataaccagatggagacgaaaaatgaaatacaaacgacaaatacattgaattgagaaagtgttcgatggatgtaggaacaagcatacatattttccttcttgcagaaagaagacagggaagaggacagtatacagctatatggaatagtatccgtcaatggagcatgagggctttatg

SEQ ID NO: 7325 - DNA, 154 bp, Bacillus thuringiensis
gtaccaatggagtattcggcgtgacacagatcaagcccttgggaggtcctggctggtaaacatagcctcttttggttaatacgtcagttaaggcactgccggctaaaattatgttggacccaaatccggaattgtatggagcccttaataaacc

SEQ ID NO: 7326 - DNA, 330 bp, Bacillus thuringiensis
ccgtgatcgacgggcatacctcggcgttgaatactccatacatacttgtcacaagaatagacaataataatggatagaatgaaaaggaaactttcctcacaaggccacggaatgttcaaaaaaactaccgaccctctgtcaggagagccaacacatcgatcgtatccaagtcgtgactctcaccgtacagggcgctcgtattcaagtcacgtttatgaacgtacgtgaatctgcttctggccttcaacctttttaaagtcaacgtatacgccgttgctccttttctagatgctgatcatatagcgtaacgtactaataacatttgatcga

SEQ ID NO: 7327 - DNA, 128 bp, Bacillus thuringiensis
gtattagcgcttgtatggacccgcgagcagaggtgcacaatggggatagttagcgtgcatgggctgagtatctgcccggcaacgctaggatcttcctgggtgaagagcgtcttcctctgtaaggatgc

SEQ ID NO: 7328 - DNA, 254 bp, Bacillus thuringiensis
tcatggctttaaaccactcctcgctataaaaacctttaaagcactcaaacatcacatttcatcatattaatccaaatcctccaacacaaggtcctgcctcagttcaaccacttctaattgaaataaatcctccaaatgccacaccctttccacatcatattccccttctccgtcttcatcatattacttctcatatccatcctaaccgtttaataaaagaacctcaattcccgttattatcacttgttctatcc

SEQ ID NO: 7329 - DNA, 134 bp, Bacillus thuringiensis
gaaaacagttgtttttaatgaactaggccacttccatgggaggggtttatttactttccggcagtgaaaaccgaaaccctattcagcactcacgatttatgaattaaaccacccgcgcatcgtagagaaccagc

SEQ ID NO: 7330 - DNA, 109 bp, Bacillus thuringiensis
taacaccgcctgctttaaaggaaacggcccagggacgaggggtgttttgtagagattgggttgttaccccgatttctctaccatctttgtactagtttgtttaattctt

SEQ ID NO: 7331 - DNA, 220 bp, Bacillus thuringiensis
gtgtagacggtcttgtacccatgcgatgaatggcgctcaatggggatggttagcatgcacgggacggggatgagccaggcaatcctagtaggctcggcatagacatacgataattttatgtcaggagggggaagataccgataagctcaatcgaaggcctaataggtacgacgggagtcaatggcaaaggtaaacataacgattgctacagataaaaggc

SEQ ID NO: 7332 - DNA, 133 bp, Bacillus thuringiensis
ccacagagggcctacaacccacgcaataaaagccgcaaaagagaaatgttaagcatgcaagggcggagaaccccccaggcaaccgtaatcgccaccgtatagagaaacgatctcctatcccaggaggcgaaag

SEQ ID NO: 7333 - DNA, 229 bp, Bacillus thuringiensis
ccatccacatccatatttttataaccacctaatactcccccaaccattacactaacctgaagactctattaaatactgacggcttatatccattccacaaaattacaatatccacctgacatcaccctcctaatgccacgcacgtaacctgataccacagaatcttctccaaactcacctctcgtccacaccattacatataatcctcccccataaaacaccccctctc

SEQ ID NO: 7334 - DNA, 169 bp, Bacillus thuringiensis
tatagacagcgcattttctatctcccaaagaagacgcgcgggatgggacgcttcagacctatcaggggcaaccccacctgacttaagacaagtccgccgtcagcccgacgctgcacacaccgaagagaatactaaaaaaaggccgcggcccaaatgtcccccaggacct

SEQ ID NO: 7335 - DNA, 100 bp, Bacillus thuringiensis
gtataaaagattgtatagacacgcgatcagaggcggacaaaggggatggtttgaatgcacaggatgggtaacacccaggcaacgctaggatgaaccggat

SEQ ID NO: 7336 - DNA, 108 bp, Bacillus thuringiensis
agattcagaaagcatataagacgcgcgagagaggcgcacaaaaggggaggatagcgagcacaggacgggaaactaacaggcagagctaggaggcacgggagagaagag

SEQ ID NO: 7337 - DNA, 190 bp, Bacillus thuringiensis
  unsure (1)...(190): unsure at all n locations
atacaccatgctgngacaatacccttgaacaaaagcatggtgggacaattgaaacggagcggacaaccaacaatcttccctacaaaaaatataagctcaccagcatcaaaagaaacagctcccaaagaagagatcacgctcatgaagacgagtgatcataacgcaactgctaaacaaccgaaaagaccgg

SEQ ID NO: 7338 - DNA, 134 bp, Bacillus thuringiensis
cagcaacacttctttttcatgaaagaggccacacccctggggggggtttatttactaagcggttgttaaaagccaaacacaaatcaaaactcacgcttttagtattacaccacccgctcctcgagtcagaccag

SEQ ID NO: 7339 - DNA, 153 bp, Bacillus thuringiensis
gtatgagcaacggtctgaatccagagcgtgagggcgtgattggacctcttggaggacgctgaaacttggggcactatgtagaaagcgaacccggtatgaaaaattagataactcacccgcaccgcgcttcgacatttacataatacattcatt

SEQ ID NO: 7340 - DNA, 154 bp, Bacillus thuringiensis
gcattaatgcatgatccaacacgcgagcagaggcgcacaaaggggtcggcacccgtgcacaggctgggtaactgactagctgcgctaggatgctccgctgtgacgagcgtcatcagttcacatgatggcgttagtacggatgagcacagacaga

SEQ ID NO: 7341 - DNA, 316 bp, Bacillus thuringiensis
caatggagtatgcaacgcaaacgggcgcgcttcacttgggaggattgttgcaatctgcccggacctcgacgtatactgctggacgctactctgcatagattcccagcgaaccataagatcaccgagtgctttctagactttttgtgttaatgtataagacctggatcttaggaccagacggacagtcctgcattaacgcttggtaaatagtccctacgtttagccgtcgccttaagaacggataaatacgttacctcactcgacaatgtaaaaccatacttggctagcttctcactgatttcataaccgtatattt

SEQ ID NO: 7342 - DNA, 331 bp, Bacillus thuringiensis
ggaacatcatcccaattaaccgatccgccgttttttctactggcagtacgcaaccagcagggggaagtatataacgatgtgggggaggatattgcactactttctgtaatgccacgcaacgcctgcctgttatagactgttacgcgccagaatggttctcggcggctgtccagttcattgaatacaaaattgttagctattaccccttcagcgcatttgacgtgacactacatacttttcatgccgatataaccacctatatatgctgttccagcccatggcagagaggaatcgtcactctgcggtgcagcgttaacgccacagatacata

SEQ ID NO: 7343 - DNA, 309 bp, Bacillus thuringiensis
tatagaaagtcctcagaggggcaaactatgccaccgagaggtgtacttttataacaaaaaagcggttaaacaacggcagaaattgaatatacaaaatggaatacaagaagatacgaaagcttaaccagctcaataagtaagcaataattacgaccgaactatcatactaaaccaaatgcggcttaacggttacacacacttacataaaaaaagaagtctacgatgaaaacgatatgcattaattcctataacctatataaaagaggatacgctaaatctcttcatctatgaaactagaatataaaaatt

SEQ ID NO: 7344 - DNA, 334 bp, Bacillus thuringiensis
caaagggatcaaatcaagagcatcctagacctattcttggggatcaaccataccttcctgccttaaaatcacttaaacccattgacgaatctctcaaagcagatataacatcctgatggaacctagattaatttatatagcattgtcaatcgaaacaagatgtcaaagtttatcatggtttataaatacagaataccattgcggcgtaagaccttacctagaacaagaccccaactgtcacgttggagaatgtgcaggagacacccagcatagaaactgcttatctcaatcggataccactagttatttatgaactatgacaaacgcaggttta

SEQ ID NO: 7345 - DNA, 382 bp, Bacillus thuringiensis
cgaaaaactttttttcactgaataaggccgctgccctgggggggttttattggctacggggccgttacaagctagagaaaatgcaacggtcacgaaacaggcgttataccatacgctactactatgtgaccagcctctcaccaatggaagctcactctagagcttaactgtcccgacaggactatatagatatcacccgtcggcccctgtagaatcaataggggtctcgccttgatctaccttacagtataccgactacctgtcggtcattgtaacatcaggaaggctgggacttttgcacaacccacactggcagcttcaccccactatgcttggggggcgcttaccacctagggtgcaagcccgaaccactcgattatcc

SEQ ID NO: 7346 - DNA, 272 bp, Bacillus thuringiensis
cggtagcggtcttactacctctccgagcacggccgctcagggggaatgttcggcatgcatgggctgagaagcgaccatacagccatccacagaaggaggtagaaactcgggatactacatcagggcgagaaggattccgaagggctgaaccgacggccaggccgcggcgatggcagttaatggtaaggttcaacactccgatgtgtacagtaaaaatgcaccatcaaggaaacggtgaataatgccctcagaacaagaaagatgccaggcgt

SEQ ID NO: 7347 - DNA, 474 bp, Bacillus thuringiensis
acattgtttattttgtactacctagcaaggccgcacggagcgtgccttgtcaccttggagtacgatgataggatccgacattaagcggtctatcatgcattcaggagtagctgataagataggcatctagatcgcttacacttttggataaggggagaactatatccatacgtgagaggtaatggaatgccttatcatgactacatacggataggaagactgaccctggggtactgaatcttttattcacctgaaggaggagatggcaaatccgattgcttgagtgacggtaagcgaagcggaacgtattgcataccaataggctggtctcttggtgatgtcgcacgttatatacggggttacagaggctcgtggcggcccaatcgacctgtgaagatccagcggataggataacaccccagatagcgaaagtgcgcactctcatgaatgtatcctgagtactgccgcacacgt

SEQ ID NO: 7348 - DNA, 154 bp, Bacillus thuringiensis
atgctagtgcctgtactgcaccacgatcagccattgataatgggggcagtttgggtgcatgcgacgctgattttaccgacacctctaggcacctatgggtagcactatgagtaccttacaaatgcggcagatagatttttatgagctgatgcaa

SEQ ID NO: 7349 - DNA, 140 bp, Bacillus thuringiensis
cccaccaatccacaccacactttacctttaccccccacctccacacgaccgtgccaggggaacacttaaccaaaactacgtatgctaaaatagccagaaagctctccagacactagccagcgacaacgctccgaaagccg

SEQ ID NO: 7350 - DNA, 240 bp, Bacillus thuringiensis
tagttcagataggaattatacattatccgttaaatgaatttgtagaggaattcattggaaatcgtgggcgaacttggtatgaggggaaaagtatagcagatgtattggcacttgatcaaagtgtgcaattagaagggcaggcgctatcattacattcttctttacaagaagcgctagctcgtgtgcgtgctgaggaggtctctccaggtgaaaaaaacatgtcaatatcataggagcgtt

SEQ ID NO: 7351 - DNA, 405 bp, Bacillus thuringiensis
gtgattaatgcgccaccactattatgaaagattgggcaggttatctgcatgacagacttagtaattaacaagtgggggttcgaaaaagaatgagccatgcttaaaacaaagggattgattgtgagagaggcacctgtggaatcactaacaaccaacgtaacgacgaataagacgctgaataattagagctgaacagtagtataggccacataatcatagtaatatgacgaagtacatatatcatgagaagcgccagaaccaaaaacaggcgtggatatcgtataactgaaaagactgttctgctgcaatatagctgcaagtgagtacaagtctacatggcccaccaaatgtataaaccaccactgatttatatgaaaatgtatttccctttgatcccatcacgaa

SEQ ID NO: 7352 - DNA, 153 bp, Bacillus thuringiensis
ttattaggggtgtatcaccaccacaaaaggaactgcataaggggtattgttagcatgcatgggcgaaggatgatccagccaaccatcggcgccagcgcgtagatcagtggtctctttccacacgaggccaatgattgcgtacagctgatccaa

SEQ ID NO: 7353 - DNA, 340 bp, Bacillus thuringiensis
gtgatcacccttatctttcttcattacacccacaccttcattcacattttgaactccaactatgcaagcgtttttaaaaggttcagcgtgaaaaatctcattatctaggcacacactatctaccgtcaagcaaggcctattaaacccacatccataaatgtcagccacaacatcatacccattcactcccaagcttcatatagaaatcaatgaaaccacctataccttccccctcaccattaatcaaaccagctccattagtcatcttcactacatattctctgcaaagctcattaaacatcctttgttgcaatatcctcccatcttcatacctgatacg

SEQ ID NO: 7354 - DNA, 464 bp, Bacillus thuringiensis
agcagactttttttcgaaccatacaaagatactacccgggggggaaactatagatttatatgcttcaaacttactcgggttgtttaatgcaaattcccgccttttagtattctggcacgaggctgtgctcacagtggtcgctagtatcatgactgagcatgttaacaggtacgaattggaggatgcgcaagagcgatatgtgagcgagacgaatcgcgtattgtcgaggagccttaaatgagacaaataatgcgccaggaagacatgccagagcagcataatctgttgatgacccggccttaaggaacgataattgagaagcagaggaagaggcaaacccaccagtctatctagctcgaggacatgttcttgttgcagaatgtgattcaagctcaagtgatgtacatgatcaggtgtaaagagcaggagtggctgtacaaggcaacggctcataatcttatgct

SEQ ID NO: 7355 - DNA, 117 bp, Bacillus thuringiensis
gatatatgcataagaaacataattacctggcacgagcgttttctttggagcttggcgaataatcgcaaatgttatctttattacttcatgcgcagggtgcgcaagaagaatgacttt

SEQ ID NO: 7356 - DNA, 436 bp, Bacillus thuringiensis
ctaatttacaaaaattttttcggattctgctctttgtctcatagtgattataaatacatgcactttaacgaaacttgaaaataatgaaataactttttcttcattaaaattttttatttcatcataaaaaatgatttctttttggatatttcacatcctttcccatagtaatcctataaggtataaaccatttataacattgagaatattcatgtatttccaatgtgaaattattgtaatggattggagagcggttgaatatagttattaaatcaaataatgttgagaaagttttatttattatatcgataaaattttatgatgtaatttattacaaatagattaagaaaagagttttaaattttccttaatcagctagtgcgaaaatatcacatactattacatacaatcgagtttcttacatttcatatttaaa

SEQ ID NO: 7357 - DNA, 131 bp, Bacillus thuringiensis
acgctagaggtttatcagcaccaccaaaagacctgctgaagggggatagttaacatgcaggggcggagaatgagcacaaccaaccaccggcgccagagcgaagcacaatggcatcctttccaaacggggcg

SEQ ID NO: 7358 - DNA, 346 bp, Bacillus thuringiensis
attcaccactcatcctttcacatactgagcctgatcatacctctcgaaaaatcgctcgctgaaacttgtatatcacctgtgggtgcaaacacctctaaatatgttacatctaattctttacctaaaactacccatacataatcataaacagtaactaatgatactactgcatcactcacgtacattccttcatatatcttttacacataacatatatacttccacaaaaagattgattaccataacaaaatgcacactacagttcaaatctactgtgcatttaaaactcatttattcaccaacatctggtaaaagtgccatttcacaagcacgtttaattgcaact

SEQ ID NO: 7359 - DNA, 127 bp, Bacillus thuringiensis
  unsure (1)...(127): unsure at all n locations
tcagaagcttgtnactaattcatattctctgatattcaccccccgatgaacaagacaacanggagactcttattgcagcaagccctgaattacttgtttcacgtactgttatgcacgttatttctaa

SEQ ID NO: 7360 - DNA, 186 bp, Bacillus thuringiensis
acttgacaattttttttcaacacattagcagatgaaaaaagtgggtcttttcatgtattaccaaagagtttaaaaggtctctcctcaagtggtcccccaaagggcatgcaacttttacttggaagtgaatgaagtgaaaacttaatattacaagtaaaaggtggagagcttttacttgaacagaaa

SEQ ID NO: 7361 - DNA, 118 bp, Bacillus thuringiensis
gaatgcagatcactttttctatttagaatactactagcactgtgcaaagggtggggaacatgtaaaaaacaggtggtacctaatagtaaggaattgatgcaatatcagaaataatcat

SEQ ID NO: 7362 - DNA, 405 bp, Bacillus thuringiensis
gtgacaagctataagggtaactgtgctagatttatgttgagctagaatcccaatcgttgagaggtggaaggttgaaaataaacgggccattagattctaaccgtgaagtaaataggagatatctggaagaagtgatttacctggggaattactgataagttcatgatcctacagccaagagtgtattacgatggattgctagggacttgatactattaactatgagcgaaaggaggcgcggctcacgaagataggcgtgagcagattgccaagcatagggtgcacttgttgtatgaagagaaccggaatccgactcgaaaacaccatggttagtagacgagctactgtgacaagcttaataaaccaaacaggtcgtatgaatggatgccatgcgattcaggatag

SEQ ID NO: 7363 - DNA, 230 bp, Bacillus thuringiensis
gaggctcgagaagaagctcgacgactaaagcaaaaccaagcgctccaaaaagaaccatggcaccctcctacggggtctgatcgcacaacgaagggagaaacaacacgcagaaaaggcagcggtccaagaataaagacacacgaacaccaaaacttgagaacactgagctaacatgtaaacaggccaggggaaaccacccaaaagaggaaaaaggcgaaaaaaacccgacc

SEQ ID NO: 7364 - DNA, 246 bp, Bacillus thuringiensis
aaacaggcggggtaaagcccaacaaacaaaaccggacaaagggagcagtttgggagcaggggccgagaatgcaacaaacaacggcacgaaccaaaggagagcacaacgatcaccaaccgaagggagcagaagatcaaacaaagccaacgcaaaagacaaaaccgggcggacagggacgctactaaagctaaacgaacaaagtacagccttacgaagaggaccaagcagcaaacaggagaccaggac

SEQ ID NO: 7365 - DNA, 304 bp, Bacillus thuringiensis
cacaattcgtgatgctaacgcggaaccgtgaggatgcgccagcgatataatatattacatgtgaaaaatgataatcatggtgttttattactacatacgttccgagaggcaatataatgtactggctcgattcaggaacgaacttatggtgcggggcctagataccatcaggttttcaatgaagaagagcgactggactgattttcctgcatcaggagaatgtgaccatacacgcgactaatcacgaattgccccgactgtgaagcaagctgactaaatgcgattcgctaacagtacactgtga

SEQ ID NO: 7366 - DNA, 341 bp, Bacillus thuringiensis
gcgctgagggcttataaccgattcaataaacaccgctgaaggggtatattcagcatgcaggggatgagaatggacaagccaatcgtggtaggcaaggtatatgctcttcgatattctttgtctggaggtgaaaggttgcgaagagctgaactgaaggctgatgaagctcgaaggtgagttaatgggaacgttaaacattccgatgtatacagatgaaacgcacacggagagaaacggcaactaatggcctgataacaatgattcatgacgggcgtgttcagtgcattaaacaacaatcacgagttggctcccgataatcaaattcaagataaaccacggag

SEQ ID NO: 7367 - DNA, 387 bp, Bacillus thuringiensis
gactcaatccgtacctttttgttcagaagaacaatgtggatagacacaggggggtgcatttcaatgtgggggagtatttacccagcagagaacaatggaaggttttacccaaagaggtttgtccacccaagaagatgttgacaaatgcaattgaagtacagacaagtgtgttggtagcggtctgaccctaagagagcagaagtgttgctactgtccaataacgcgacaagactggacatacagacattgaaagacgactatgcggtcctatagaagtctgaatatgacgaagaaaggatggatacaccatttcaaagagtgaacattatggaccagaatgcaaagataagccttcgggagacgttccctgtactgggtccccatggg

SEQ ID NO: 7368 - DNA, 143 bp, Bacillus thuringiensis
aaacgggaaagacaacaaccgaaaaacacctctactcaaaacagacaaacaaggcgaaaagggggggcacccaaaaacaaaggggccaaaccgaaccgcccaaaaaacaaaccaacacaaacaagacccccgagcaacaaaaa

SEQ ID NO: 7369 - DNA, 178 bp, Bacillus thuringiensis
ggattgctattctttttctcgcagaagaatattttctttctggggaaactattaaaaagattgcgtattctaaataagaggaaaagagtctgattcatatattactttgaatcagactctttttgtcaatatatgcattggatatatgaagcgtgaactggcatcatattatcaaaaa

SEQ ID NO: 7370 - DNA, 246 bp, Bacillus thuringiensis
gcactctggaactagcggggtttatgaacggatatgttcttttcaagaagccgtactatcaccaacccagtttacattataaccatacacagcttttggatgcttacctatccttacgcgggttcaccaagattttattatccctctggttcggtatttgggttaaatggttcctactttaactgctgctcactaagttccctgtttaactggggcatgattagtgtctagctgtactgtgagatc

SEQ ID NO: 7371 - DNA, 306 bp, Bacillus thuringiensis
atacgaagcttaattaaacgattcaaaaaaagaaatttgctaatctcaacaagtaattgctgacaaagggagacatatagaacaattacaaacaaacatagatacacgtcaggaagttattaaacaacgatttacaatctatgcaagaaaaacctcgtacaaatatcattacagaggtactaacaaattcttcaaatattggcgatcttgttgataatatgtactccgtaagtttaatattaaacaacgatgcagatattgtcaaaaaacaaacatctgatcaaaatgctgtgacgtcagaaaaag

SEQ ID NO: 7372 - DNA, 102 bp, Bacillus thuringiensis
gtactagcgcttgtatggacccgcgaacagaggcggacaaaagggacggaaagcgtgcataggccgagtagctgactaacacccctaggaactctcgggttg

SEQ ID NO: 7373 - DNA, 117 bp, Bacillus thuringiensis
attatgaatgggtcattggttagaagcaccaggaatttcttaatccgtcatgctgacgctaaactattgtgtagtagatgaattacttgcagaacggttagcggaacaatttctttt

SEQ ID NO: 7374 - DNA, 147 bp, Bacillus thuringiensis
ctactagagctgttatagaaccgcgaacagtgctggacaaagggggcagtttgcgtgcatgtgccgagtatcttaccgacacccgtaggaacttacggatagaataatggcttcctaggaaatgaatcagttagttctgatgagctg

SEQ ID NO: 7375 - DNA, 111 bp, Bacillus thuringiensis
ccagggatctccatcccccaacaagccacacccaacgagggggtctatcaaaaaatttcggggggtataaccctccttccataatctccgacccccccgccgaacccttcc

SEQ ID NO: 7376 - DNA, 129 bp, Bacillus thuringiensis
tcgtacaataatgggtactgaaccagcaagaattctttccgacggagcagaaaagccctgcttggaagatgcatcgacgtcagacaaactttcatggactgcaagagcctaccttttttttagcgccac

SEQ ID NO: 7377 - DNA, 269 bp, Bacillus thuringiensis
ccataatacttctaattttcccacccctcaatgctcccccttcccttacacaacctaggggggctttttaaaaatctacggctttcaacaattcctcaactatatcaactcccaccaccccccttcccctttaatattattcaaaaccctaaccctccactctacttactttccccctttcatccacactttataacaaatcctctctcattctacactccctcacatcacgtttttatcactaccatacctccacccaaacccccttt

SEQ ID NO: 7378 - DNA, 113 bp, Bacillus thuringiensis
caagttttgtttccccaatgagcgcgccccctcggaggggatagtttaagcccccgggccgtagaaaaaacagaaacccaagtcggcacgcaagctacatgtatcacaccgcc

SEQ ID NO: 7379 - DNA, 347 bp, Bacillus thuringiensis
ccttacaaattttaattaactcaccaatactagtggtaactgctattacacaaacttcagaggcgtttttaaaaccacgaggggtcatacacacctctactagaaattaaacaagcatgtgcctaccggaaagacagattcacgctaattcaataacctacgttatttctttttccaggatacatacaaatgagagcacatcccctcttacatctaatacctttacactagccgtcataaaggctaactatcctgcccctaatcctgctttatccaatatagaagacgatgctcccctctgcaaaacaatgatgttgcctacaacacaaaatccgacccctgccacg

SEQ ID NO: 7380 - DNA, 136 bp, Bacillus thuringiensis
ggctggagtcctcgttacagtagatggcgaaagaagtgggggggttattctatgttgcgaggcgaccgctctagaagctcgtatggctgcatcatagaaaatggaacaatcaatagagtattcagaaaggtcaaca

SEQ ID NO: 7381 - DNA, 216 bp, Bacillus thuringiensis
ttactagcgctggtattgacccgcgatcagtggcggacaatgggggtagttagcgtgcatgggccgggtattttcccaacaacgctagaaacttcttggttgaacagcggctaccttgctcaggatgcggtcagttcagacgagctgattcagcagactatgccggtcgaacgtggacaatggataaggtcaacacacgggtgggaatttccgatg

SEQ ID NO: 7382 - DNA, 248 bp, Bacillus thuringiensis
actcccttgtacatcatcttcatacaatcttattttcccaccattcgatcataaccttccaagaccattttcaaactaaatgcgtccaaaaacaccgctcacatgaataattcacacacacttctccatcttcacaaaacacttccctcacatattttacccaatcaacaccatcctccctaaccccacaatatctaacatcaaaccccatttcttctaaccccttatatcgctccatacacacaccc

SEQ ID NO: 7383 - DNA, 448 bp, Bacillus thuringiensis
gctccgtaactacactctctttgtttgagcctgcctttattcttttcacggatcaatactcaactctcgattcagaagtcatatgggagcccatctttctataaacgtgatgcttattaatttgtctactacgactcaagagagcccaaatctttatgtttggatattcctaccctattaatctcataacatgtgaaccaatgcctcttcctcgattgacaggatctacaaaaataccaccaatttgcccggaccacttaccagagatcgcaactcttatgcctgcaaatgtccatacatccatgacaactgtgaaagaatccaatgcctcaatggagtagcccctcatttcaactgcagagcaccctggccggtgaatgtaacaatcaaggccctcatcttggcccgatacccctgggtcatgcttctgcaccaaaaggtctttttc

SEQ ID NO: 7384 - DNA, 150 bp, Bacillus thuringiensis
tgaacgtcaccaatcagttattgtcaataatccagggtgcagtacaggaggaccacgccctgcttattggcatgcagtttggaatggctcatgctcatataagaccactactcgtgatgggtaggaatcccatgccgttgaatgcatgga

SEQ ID NO: 7385 - DNA, 146 bp, Bacillus thuringiensis
gaagcttgcgacgaataagataaatttttttcccgaatgaggacgctacgacggggggacgattagccccctggcagatttaagctcgcaaacctgttcggccacaggatatatgaattacaccacccgcgagggaggtgaacagc

SEQ ID NO: 7386 - DNA, 121 bp, Bacillus thuringiensis
aattgaatgaacctaagaagcttttctttccacacgaagtagtccaagatcatgagatgaatcatcaagttgtgaaagaaaacaaacccattgctaataaacacgaagaaagtaacaaatc

SEQ ID NO: 7387 - DNA, 223 bp, Bacillus thuringiensis
ctaccgaatgctacctctgctatctttccaaaagcgactactcagctcaggacgaccacaactagataattgcctaccaagacataagcacccttgatcatttcaatttgctcctgcagcgcgaccttcgacacgtagccgtgaatgcgtgtccaaaacctgccccattttaactatccgatacctccactcgggggtgaccacaaggcttgatacctcgtaa

SEQ ID NO: 7388 - DNA, 330 bp, Bacillus thuringiensis
gcggtagcggccgcggcggtggcagcgaaacctgactgatatggcccgcatccggtactgtcaacagataagggacgagtccgcgggattgactgttgccgactgcccatgtacggagatccggcattagaagacgtagattcatggactggtgtagtatgacttgcatggtccgattgctgctgctgacttggaggggagtacggtggagggggggatgacagatttcatatcgaagtcagcttcacgcaaagattataccgaactcactgtttagcgctgatgcacgaatcagggaacatcactataactcaagaaagtcggactgac

SEQ ID NO: 7389 - DNA, 290 bp, Bacillus thuringiensis
tccagaatgcgtgaccaataccgctgaacgtgtgcatgctgaacggtgagcgcgagaccgaccgtgaataccccaagggtgtggcgcggaaacgcaccgttctcacgatatttccacacactctaataacaatacccattactaacattgataataaaatcgccacacactaatcctacagtctacacacgcttgcatcaacttcatgcttacgtacaaagcaaaagtatactcacacggatgctcatcatgtacatacattgtactcgcacccgttatatcaccgttat

SEQ ID NO: 7390 - DNA, 402 bp, Bacillus thuringiensis
cggcgttgccgacatcgtcgccactgggcccgtcgatgacggtttgttggcgacgccagtgcggcttgacaatggtgggcttgtcgacgttgaccgagtggttgtcgacgtacgactctgttacagacgacgcgaactcgtttactgttggaatgtctgcgacgttgccgatgtcatcaccagaagcgccgccgatcacggtgggcttatgaggcactttggggaagttgtcgtcgcggcggtggtggtgcttatggtcaggcttgataatggtggtcttgtcaatgtccacggagtggtcgttcttgtaatcctcattgacctcggacgagtacgtgttgacactcgctgcagcaaagcccgtgccaatgtcgtcgtcgctgggaccacttattacacttg

SEQ ID NO: 7391 - DNA, 103 bp, Bacillus thuringiensis
accacaaagtatatttggagaagataagaagtatggaacgcgaaactctcgctagcaataaagtacaaatgtcgagcgttgctgagcagagctctatttaaaa

SEQ ID NO: 7392 - DNA, 567 bp, Bacillus thuringiensis
ctgcggtgtttggtgagggcggttattgtgccccgtagagtgtcggaagagtcgccggcgagaccagtatgtttcaaagcgccggtagtaacattccggcttgtaggcctttagaaagcctatttatacagtaccagtgcgtatctggggaatatgttaaaggtttgttccctatagtgttatgcgagagtatattttgcaaaagccgcgtatccacttcccaaggccggattgtgccgtcgagcatgatgcgacgtctctcatctggtgaaagttgtacctcttcacggcgtacgtatgctcaatttgattgtattcgggtgacttccaaatcctaactgtgccgtctcctaatccagaagctgttagtctgccgtcaggtgagaagagtcgacactttcggagtacattttcagcgtactttgtgtgttctgatgtctagctgctagacctggatatgctctcctgaattggccatcggctaaagctaatgtacaagatgcttctttagaaagggaagaatttgctccaaagttgcttgcttgtgtaggctttggattaaataat

SEQ ID NO: 7393 - DNA, 229 bp, Bacillus thuringiensis
aacgataaagcatgttattaagaatatgcagctaaacgtatgggaagttatcaacggatgaaatatttgagagcaatactaaatacccactagaaggtgatttgtctgctgcaacggcattcaaccgtataaaaaagagatacttacgtttagaagtaatacagtaagctccaatgcttgagacaacaaatgcaaaaattgcgcaaaatgaggagaaaatgaaagccga

SEQ ID NO: 7394 - DNA, 298 bp, Bacillus thuringiensis
accgggcggggtttaaggacactgggactccccgaggccaaacgtagtcgatttagtatgaataaccgatgctgtcgacgaggttgactgtcatttcatgtgacagctctcggtattcattttaacacaggaaccatgctcttacaaattcttataagatcacgttatacctaataactctatctccatacgagatccacgaccagaccaattagtgcacgttcattagaaaccaagtcattggaagagaaatccttatattctagaactgggttagatgtccttaataccgttggtg

SEQ ID NO: 7395 - DNA, 237 bp, Bacillus thuringiensis
tggtatgtctgaagagagtcttgcgtcttcgtgaccacagtaacttgggggggatccttactacattaattgtccacacacttatctcctatttcactatcctctttcttcgcagctccactcccttgtatagttgatttctaatacagtacttcgacttaaaacgttcacaatggtaacatctcaaaccgaagaactttaacctatattcgaatcccacacaacgaaatggagtcg

SEQ ID NO: 7396 - DNA, 191 bp, Bacillus thuringiensis
gatgctagtgtacggattattttgtttgacttgacgattatcatgtggcgcgtggtttcatctaactgggctgcctacatcctgatttgcacgtccctctggtactaccattggacgaccatgtggtcttaccgtctgacgcatgtcttcaaggcacatggggacccaatgatggtgtctatccacatgca

SEQ ID NO: 7397 - DNA, 314 bp, Bacillus thuringiensis
ctcttgccgccttctgtctttgcttccgccctcctgacacaggggacggatattttgttaaaagtcaggggatgcctaacctcttgaccgtattaaccttccgtaccccactagacgcccgcctcgcatagaaagtggaccagctctattaccataaaccgataagccttctagaatattaaaagcttgaaacatgaaacctacttactgagagcgaatatcagatcatgcattgcccttcatagcaagttatatctgtacccactaatcgtcacactaccacctgccgcttggtcaagtgtacttctcacatt

SEQ ID NO: 7398 - DNA, 620 bp, Bacillus thuringiensis
  unsure (1)...(620): unsure at all n locations
actcgcatagtttgatatgttcgcgtgtggctgtatcagggcagttgtagatgggtgtattttagggctatcagtctggccgaccaagacaaccgcataactaggtgcatgaatctattatcggcgaaattttgatgggtttagaacggaaaggaccgaatgaaagattcaaagtatctttagtatctgtgtttggaccatgagtggacgctgtcaaggacaaggtacgcaacagtgcttctgcatgcgctacataaacaaggggaagataaggaaaataagatatatgggctgcctcaggaactgggagtggtgtgcaatagttcgaagttgatcaataggaatgccggaagcaagaaggcaccaaaggtcataaaagagcaccgtctgcagatttgacgtggttcggtgctttgagacaaactggggtttggcttctcttgtcaatgagcagaggtcagcatatgcgagatatgctgcatcatccctcaatgtggagaaagggcaaaagtaaacacgtgtacggcatgtcttataactagtcgagaatcnatggagtccagtcaatatctgtatgaagtatagaacggctggaatgcctgaatgtcccataacatcac

SEQ ID NO: 7399 - DNA, 161 bp, Bacillus thuringiensis
cttggtgagcctaaacagtttgccaactttttttttgaggattgtaatcagcagaacgggcactaaaaaccatactgcgcttaacaaattgccttgtctcttgacgtttcccttgaaatttggtcactataattagttctacgttgattttaccgcactac

SEQ ID NO: 7400 - DNA, 100 bp, Bacillus thuringiensis
ttacagcagcgcgaacaaatttaaacgtccttttttaaagacacacgcaccaactactaagggggcttttttcatgaagcacgctgtcacaaccaccggt

SEQ ID NO: 7401 - DNA, 124 bp, Bacillus thuringiensis
tcaacaaccgcgcgaccaaagagcaacgccctcttttagtgcggcacccaccaagcacaaggggggacttatacaggaagcacgcggtcacaagcaaacggaccccaaaaaccaggcaccgcac

SEQ ID NO: 7402 - DNA, 193 bp, Bacillus thuringiensis
catatttttgaaagagctttatttgtaatgaaggagataccacaccgtggccacttgataggggggcaagatccaggagttggtttatttgttcgactccaccgaccacgatactcccatttagttgctccgccgcttatacaaaggcatgaagggggatagcgccatgagagaccactgacatcggagaaac

SEQ ID NO: 7403 - DNA, 120 bp, Bacillus thuringiensis
gctgtccggatgcaacgagcttggcaaagaagagtcatagactctggctccatcacacggtgatggacgctggcactcgtggttgactattgatttagcctaacacacgctttgggactg

SEQ ID NO: 7404 - DNA, 135 bp, Bacillus thuringiensis
caagttttttttatcgaatgagctagctgccggacagatgacaatttaagcccactgcccgtcgttataccagcaagactgtggggcacgctggatttctgttttacaccgcctgctgatggtagtcgatacacc

SEQ ID NO: 7405 - DNA, 122 bp, Bacillus thuringiensis
aacccattcttccaaacacaagaacacattatcgaaaggggatttataaaactgtcacccctaaaaccccacatggacagtaattattaattaaaaacaatcatctgacttacaaaacaaaa

SEQ ID NO: 7406 - DNA, 195 bp, Bacillus thuringiensis
taacaaccgggcatccaaaggtaatcgcccgcttctattgcggcgctttccaagcacataaagggccaacttcgggaggcaagggggcatattcttcaggaccacaaaatgcagggacagcacttcacaatgcgcttcccaccgacttgcactctattgattacgcgatactggaagagcacctgtcgctctccg

SEQ ID NO: 7407 - DNA, 195 bp, Bacillus thuringiensis
gaacaactgggcgtccaatgagattcggccgattttttagaagagcttttgaaggagttaaagggccaaatacgggcggcaagggtggatattcttcagtaccacaaaatgcttgatcagcagttcaagaagggaatcacaccggattgcatactactgattgggcgatactggaagaaaaccggtcgtttaccg

SEQ ID NO: 7408 - DNA, 178 bp, Bacillus thuringiensis
taaaccatttcaactgcccttgtctaacccggcctataccacgtactgcgggggatgtgtgcatagagcatgcgacatcacccacttgttggctactctcttgcgacggaaagtccggcaacaattgtgcatccggaaaacgtcctttaaggccactaatcaggagttcattaggacc

SEQ ID NO: 7409 - DNA, 180 bp, Bacillus thuringiensis
caccggtttttatagcaacaggtgcatactctccaagggggggttataggacatgcacggctaaagcgccagcctgacctgaatttcgagtatgcggcgaaaaagtgagttgcgcaatacagattggagactacgttagcaaagggaaaacatgataaagcagcgaagatgcctgccgtc

SEQ ID NO: 7410 - DNA, 173 bp, Bacillus thuringiensis
taacatcaggacttccaatgagcttcgtcctttttcatagtggcgcttaccatgctcattggggaacaacttctggcggcgcggttttttacgctataggaccccaatttgcttgttctgtagtttcacgaagcgcattacacgcgtttgtactctactgattacgcgtaact

SEQ ID NO: 7411 - DNA, 157 bp, Bacillus thuringiensis
tacatctgggcgtccaatgatcatagcccgcttttttttaagagctttccaagcacataaaggggcatttttaggaggcacgggggtatattcttctgtaccccacaattcttggacagcagttcacgattcgctttcctacgtgttggatgcaact

SEQ ID NO: 7412 - DNA, 181 bp, Bacillus thuringiensis
gaacagctgtccatccaatgagtataggccggttttttaaagctgcgtaacacgcagaaaaagggggaatttctggtggcatcggggtataatatctcggtccccccacaacttaaccagtatgttagaacgcgtattccaccatttagtaccctactgcttatgagacactgggactata

SEQ ID NO: 7413 - DNA, 185 bp, Bacillus thuringiensis
taacaaccgtgcatcctatgcgcatcggccgatttttttgaagcgctctccatgcactaaaagggactttttctgggggaaacggtgcatatcatcttgtgccacactttgctacgccagcagattagaacgcggttaccagccgattggaaactactgattacgagatacttcaagtaaacctg

SEQ ID NO: 7414 - DNA, 237 bp, Bacillus thuringiensis
cgccggttctccgacctacatgtacatatacccgaaggggggcttataggacggggaccgcgaaaacgccaacttgactgtacatattatatgtacagcggccaattgacgagcgaaacaaagaccgcatctcacgtagaacaatggcaaacctcgtcgaacctacaaagatgcattccgtcaaggtaacgaagcacacgactgacccactcaggcactacaacaccatctaccaca

SEQ ID NO: 7415 - DNA, 185 bp, Bacillus thuringiensis
ctacaacagatccaaaccttgccataggttttttttattgatgcgatcaacaacctctgagagggatctcttcataaagcacgcgatcaaatgcttatgttccccaatatacttgaccagcaactacagcacaaattgtttcaaaagcaaatgctgattcttacgcaaataagaaagctcaacct

SEQ ID NO: 7416 - DNA, 214 bp, Bacillus thuringiensis
ttgatcaagggatcaccttgtttcaaaagggacagtttacgaatgataggcagacgactgaactcttctcttagaatgagcccgacagtgaagagaaatacaatatcaacatttgttgataaggggataccccatactggtcgtttgccaaggccatgatagaaaattgtatgtttctgaagatgcaaacctgaggcgcccgtgataccgatgg

SEQ ID NO: 7417 - DNA, 181 bp, Bacillus thuringiensis
accggtttctactacaagacacatacctgaagggggtttataagaatgaccggtaaaacgccaattgagtgaattattaaattacggcagacaagtgacttgggaaataaaaattggatcttacggtaacaaaggcaatacacgccgaaactacaaagatgccttgcgtcccgcacaggaa

SEQ ID NO: 7418 - DNA, 114 bp, Bacillus thuringiensis
taacaaccgcgcatccaattagcaacgcccttttttagcgcggcgcccttcaagcactaaggggtataatttctgggggcacgggttcatacgctacagtaccccaaattgctt

SEQ ID NO: 7419 - DNA, 299 bp, Bacillus thuringiensis
agttggcatagtatatgcagtccagctatgctacttgatgagccgtggtaattcaaaacgcgaagcagtatctttttaattattcgtggattcttaggacctgcaattaaatgagcttccaatggatagaagaaaggcacaaccttggttatgtaaattccagggaaagattgttaatggaataattcatggaaaacgttatacaggtttccaaatttttggaccaaaaaggggaacgggaaaacaccttggttaatttcgattggggcaagaacttttttaaaaaaccaattaaagtc

SEQ ID NO: 7420 - DNA, 197 bp, Bacillus thuringiensis
gagtcttgttcggattatctccttggaaccataacgcaaccattaagatgaccgctgcacacgcattgttttgtggcatccacacccacatttcgtgaaataaatgtactaccttctgcgacttttcattatacattacatagagtccatcaatacttaagcaatcattgtgaacaacaatgtgaattagctcgcac

SEQ ID NO: 7421 - DNA, 344 bp, Bacillus thuringiensis
gaggtaccggcttctgaagcgaaagatcttccagacttatatccccgctctcacatttccaactgggtgccacctatccacaccatactgtggtaccatctgcgtgtgctctgatagagcacctcgctctcagttgattgtatggctgtctggttttcaatcagcatgaatcaaccgacatgcctgcgcacaatgcacctcactggatagggcacgaggtatacttatagatctgacagagttagccaacttttactagtggggaaatatgagggtggctatgcagatggacgaggcctatgcactgaccacgggatcactgtccatgaactggatgcgtcact

SEQ ID NO: 7422 - DNA, 136 bp, Bacillus thuringiensis
gaaatttcgtctagcccatgaactaggtcacgggggggggattaatttagaaactgggccgtagtaacaagcgaaacactgatcagcactcaggcattatgttttacaccacgagctcatagtagtcaaccagctt

SEQ ID NO: 7423 - DNA, 382 bp, Bacillus thuringiensis
ataacgcttacgaggttagttgtcggattcgggcctatgagtagccctaccttttttaaggattcaccccatcggattatgtactaatccgtaaaaacgggtcccccgtaccatgcggtttcagcgatttagaaaattgaaactgtggattataatactcctttattttcaaaaagtaaacaaaaatttttaataagaaaaaaattaaaatgattgtgcataatccactgagaaatatacattaatgaatactaaaaaatccgcaaaggagacccctatgtctaaagaaaaagaaagcctattttttccgatttatatttagatgcaggatcaaaatgaaaattaattcagtatttggtatacgtgaacctggatataaatt

SEQ ID NO: 7424 - DNA, 142 bp, Bacillus thuringiensis
gtgaagaaggtactgtcaaggatgcattccttgtactttaataatgacggtggttttaagatatggctggctggaaccataccttcttaaaatttgccctaccgaaagaattaattggtacgtttcttaatgaactggtgta

SEQ ID NO: 7425 - DNA, 197 bp, Bacillus thuringiensis
gaaacgtgacctatgatacttttttcactcccaacgtctgaataaacgccgggcgtgtctgagctgacacatataaacactgactccctagaaacggacctgtcacttttggcttcggacgaaacgctaactataccttgctgtgtgcctgatacatacccgtcattcactgatagatctcgtcttttgagaatact

SEQ ID NO: 7426 - DNA, 198 bp, Bacillus thuringiensis
ctaacgcggactatgatttttttatatgtcactccgtttataaacacggcgggcccgccagtcccggcggctgtaaacactgaatctctagcaacggaggtgtcaatgcaaggttgctgatgctacgttcgctctacttgtctgtggatctgatacatccgcgatatgaacagatagaaatcgtgtatgttgaatggt

SEQ ID NO: 7427 - DNA, 217 bp, Bacillus thuringiensis
tatactacaaatacagatagttaaaatccacgaccgagacacgtatcaccaggggggtgtttgagaatatgctcccccggtaaaaacccctaaaaaaaataccgaaacataatttttaagcaaatttgaacccagatctactacataaaaatacgctattaacgagtttatagctagacaaattatatgtaaattaacagagctaccactaaaatgg

SEQ ID NO: 7428 - DNA, 536 bp, Bacillus thuringiensis
cccgctcatctgtgctatgaatgagaacggcgcgttacgactccaacttgacgtccttgtcctgcagcaaaatctcaagaacgtcatcatcgatcccactcagataccgccaccagatcaggctagaacgcctcaagcagaactatatcgtgaggttgttacccttcctcggagcgccaaattcctggactggttcctcgaaggggcagaaaaggcgctcgattacgccaaagaagaaaaggagcgtatggctgcgcatggcgatcaggctcttgcagacggcgacccttttagttatgaagaactcacggtcctggttgatttatgtttctcggagaatctcagagggcccaggagcgaggataaccgggaagattttatggcgtcgaagaaggcgagtgcagatgcactcttgaggctgaacgaaatcatgtgggattccaagtaatacgtctttcgcgcgagaggctattataccagcagtaatgatactctcttctggcccagtaaggattacttgtctcgtcagcaaccac

SEQ ID NO: 7429 - DNA, 196 bp, Bacillus thuringiensis
agaaacacgtttctctacagaaaaaggacacaccaacgggggggatttataaacaaaagggccgttacaagcccaaaacaaagaaaaggtcacgctacaggcgcgacaccatacaggcctcacaacagaccagccattcacaaatcgacgctccctcgagagcagaaaaaacccgacaggaccacaaatataccac

SEQ ID NO: 7430 - DNA, 275 bp, Bacillus thuringiensis
gagaagttgcgacgaattagatacatttagcttgcacccgacggcacctaacagaaagtgtttctaactacgtgccagcggccgcggtaatacacacgcggaagcgctatccggaattatatgggcgtaaagcgcgcgcatgtggtctcttaagtcctatgcgaaagcccacggcttaaccccggaggggtcatggaaactggggagacccgagcgcctaagaggaaagcggaaccccatgtgtagcggcgaaatgggtttagaaaatggaggaa

SEQ ID NO: 7431 - DNA, 209 bp, Bacillus thuringiensis
caggcacggaagcaagccgacgaactcagatagaaaaactttattttacagaaagaggccccagcccaggggggggcacattaagatcagggccggtaaaagccaaagaaaaaccagcggccacgctacatgcactaaaccacccacgaccaacgagagaccagcatctaacacaccgaacctccgaggagagcataacagacccgaca

SEQ ID NO: 7432 - DNA, 198 bp, Bacillus thuringiensis
acgaaaagtgaatattataggcgttggttaatatcggggatatggggcgaaagtccctacctagataccgtaaatggcttgactacgaggcgcctgcataaagaagcggggaaacttgtctttgtttatagaacgctttccattttagatgcaatggatgtccttttcaacttccgggataaaagagggctatggaga

SEQ ID NO: 7433 - DNA, 384 bp, Bacillus thuringiensis
  unsure (1)...(384): unsure at all n locations
gaggttggncgccattttaagacccgggcccaatttatttgcccggtttggaacccttaaaacagggttggggaaaaaaaccgcggcccctggcgcaaagggtaccatttctttggaaaaggcctttggaaaaggcataatccgggggtttattctttgggggggatccttttttttacctaaaaaaaaaccgtaaccaccttttatcccccttggggggtccccctaatcatccgggccagggaatcctttggggggcctttttttacccgcattttaattccccgctttatacccggggaaggattttggaatgggcgcccttttttggggtctattttttagtattggaatttattgggggggtttttaaaattttctttt

SEQ ID NO: 7434 - DNA, 205 bp, Bacillus thuringiensis
aacaatttatacagagtgagttgaaaagaacattaattcattatgagtaagaaaataaatcaatttataacgggttgattgaaaagtttattcagagaaaaagaagaactacatataaaagggatattgctgtttttcatgagaataaccataactatttttaaaattgcaaatgcgctgaaaatgagaaatgatttatgtttta

SEQ ID NO: 7435 - DNA, 215 bp, Bacillus thuringiensis
agaaaaaagtcgtttcccagaaaaagggcactacactgggggggacttattgaaaaacgggcagtgaaaaccgaaagagctacagacactcaagctggtgaagttataccaaacgcccctgaaggcagaccagcagctgacgaatggaacatacctgcagccgatagaggaacagacagtgccataaagggagcacatgccagccccacatgcca

SEQ ID NO: 7436 - DNA, 174 bp, Bacillus thuringiensis
ataacgcgcactaggattttttttggattcgggccggtgagtaaaccgggagtagttatacgatcatcattatcagaacatggactctgccccgcctctatatgacgcatgcgcaccatgattcacgcacatgaaagttgatactggggaatatacatgtgcgtgattttgaaa

SEQ ID NO: 7437 - DNA, 218 bp, Bacillus thuringiensis
ccacataatcggggcgctctctggttcgggagaccgtccaacattcgaaccactggctgatttagagtcagattctgttggagagactatttctcaatcagctgagcttgctctgggacaaagaacagtctactgcagtaggtaaataaggctgggcagacccggcatgtcaactttcagaggtagattaatcgcctggaaacattggataccgctta

SEQ ID NO: 7438 - DNA, 570 bp, Bacillus thuringiensis
  unsure (1)...(570): unsure at all n locations
tgacgtggcntgattgatcatatagctcaggaagttccactttgcagaacgtttttaaaggacactgaatcattagaatcatgaggtaaccttgcatcacgcatcggttcttacgttacatccagagatttattacttgatatctcagtgatacatctgcgtctgacaagttaagaatgttcattgtcaagtcctatgtattgttggctcagggctgagtgtccatagcctttcctgcccgtttggtgtcggcagccttctcgaaaatgaaatagatgatggtatatagtttcagtttgaggtgctgttctggcaatctctccttgattgctcagcgtcggaagtggattggaaaatgccttagaatgccctataccatggcagatcccgagggtgcagttacgcgcaggctgttacgtgattttcttctatttcgttgcggcagaacatttgcgtgcggctcacagctataaactagagacagagcttatgggagagaacggtacatatgctctagttggtagagctcctggaatagatggcatgctgttttcagagaagggatgcaag

SEQ ID NO: 7439 - DNA, 265 bp, Bacillus thuringiensis
ccatcacaaatacccacagggaacggttgcaaaacattaggggtgaacctgcactacctaataagggagctatcctacatgcctcgaggggggctaactgaccactttccagaagacaaacctaacatcccggttgaattaatgaatcggacagcccacgaaagaaagcgagtgaagcgtaccagagcgatctttcataaaccgcttcactgactaggtgcgctattacggtcaggtggagctagcggtcttatcatactcaaag

SEQ ID NO: 7440 - DNA, 277 bp, Bacillus thuringiensis
tcccaattcgtgataccttcatttcttttggcaatcatactatcttttatcgctcaaattccgttacttatcgatgggttcacccaaaagtggaaatggagaagtagctcaaatttgctaagaataactactggtgtattaagcggtaatggtatgggattattcatttcctctagtgttatatggatattatcttaagatatatagtaatggaggtatttacatagatgttctggatctatttaatcctaatttttatttcaggcggaagtggcat

SEQ ID NO: 7441 - DNA, 323 bp, Bacillus thuringiensis
ctgttcccatgacaatatcaccgtctccgacttcaactatttccgaggtacctcgatcattacgggcgccaattttagatagcttatctctaccaactgggcatacatttacataggtcactgttacgtctgactgtcgctctggaatcgtatcgggcacatctagcagggcatgctaaagcctacatagctagcatctgcccgtatatactacggactctcacggagtgaccacaagctactgtacggattacacacgatctggtgtgactgtcccccctgaaatacgaccggtatcccttctgacatcccctgcttccttt

SEQ ID NO: 7442 - DNA, 134 bp, Bacillus thuringiensis
agaattttttgtatcgcatgaactcgctcccccgggggggactaattaagccaccgggcggtaaccacaccagcaacactgatcagcacccacgatatatgtataacaccgccagctcatcagagtcaaccagc

SEQ ID NO: 7443 - DNA, 348 bp, Bacillus thuringiensis
aacttcccaactctgagaccaacctgggtacaccggcaccgggggacttaagagcgctatctggtgtacctacctccgctggccaaacggataagttacgattattaactgttgtaacaaccgatgcttgtgctcgcgaacctttgtaactgtcagttcatgttactttactttctgaatacaaataaaacactggacaccatgcatcttaacataatccgagataagaatctacgccataaccaaatcaactcaatacaacaacactagatgaactaccagacccaatatgtgctctatcatatataaccacgtatttggattataactcgttattttcaaaaactg

SEQ ID NO: 7444 - DNA, 580 bp, Bacillus thuringiensis
  unsure (1)...(580): unsure at all n locations
cggcggccatgccccggtttgcagtcggcacgtctgatggtctctacaccttcgtaggcttcggaagctactggacattatgcaagaagccctttcccaatgacaagtcttcaggcaaccctaagaagcgccgcaccgactcctcgcacgcccttatcacagccgttgaatggctctccccagacgtgattgcggccggtctcacggactccaccatctttcttcacgacgcccgctctggtggaagcgcaactagacttcagcatccccatgcggtaactaaaattcgcaagctcgatccgtatcggatcggtgtcgctggcataaactcggtatgcatgcattgatccctatatccaattattcggccctcttatggactatacctccagtcgtccatctttgccgtttgactatatacaagccgactcacgagacttgcttcacagctgcaaatgtacgacattcggtaccccccaaataacctacaacgtaaccccaacccaaacaagagacagcacactttgactcgcccgtacctgaccttntncaccaactaccccgagtgaatatcaccccg

SEQ ID NO: 7445 - DNA, 370 bp, Bacillus thuringiensis
ttggatgtactccgacataacaggagagcctcaattgtgccaattcttcgaagttttgagttggaggtccgttcttgcccaaatataagccttgtaactagctgttggcaatgctgtcacagacgatgatggataaagaagtttcttgactcgccacctggccccggtaatatatggtacctcgaagataacatgagcatcgtgcacaacaggacgggatcacaggtgatcaattcgcggcgatttccgtggttcgcatacgaagtcggtcaggattggggacaatgaggacatgttctcgtaaaatctggctcgcatgagatcaaccactatgctgaccacatacttaaacatagggcacttacaggtc

SEQ ID NO: 7446 - DNA, 151 bp, Bacillus thuringiensis
tcgtgattattgaattagaaatacaggatgacaaatatggttttagtactttgaaaacactggaggaggaggtgtcatttgggacggagaagaaaaaaccataacatacatactaccttatttacaagatacgaatcgtgacattcgtaaa

SEQ ID NO: 7447 - DNA, 323 bp, Bacillus thuringiensis
agaaacggagagcaatttctatcaaacaatagcatattgtgaacatcacgcgcttagatgagagcaacggtcgatcctgcatgcttaagaacagtgccatgaatatgggctactctagaatggttcagtcgcccctatgataagggcatgatcgtttcgatctatacctaataggataagcttaccgagtcccacctgcaccaatgagagctgctaatgtagccgctccaacaaggaaataccgttgctgcacgaataccccgtcataatgataggcaatgcaagaggaaagttgtacctttcacaattttttttcaactatt

SEQ ID NO: 7448 - DNA, 162 bp, Bacillus thuringiensis
gcttcaataccacatggggctttttttataacgtcgccttagtacatcaagggggacttctaaagccgtcgctgctccacggaatttacaaacagaatcaacagtagaagaatatggaggcatattattcactacaagcatacgatctagactatttacatc

SEQ ID NO: 7449 - DNA, 138 bp, Bacillus thuringiensis
tcggatctcacttgcaagtacgataaagtctgattcgttgataaatatgtgctcatataaactctccggaggggtttaatgtagttgcaacagcttctgcattgacaagtgcggaatagtaccatgcccaacgcatta

SEQ ID NO: 7450 - DNA, 193 bp, Bacillus thuringiensis
ttgtcaatcacgagaatttttttataataagacccgtaccacccgaaggggaacttattgacttccaagcccccctcaatcatacttaccgaaataaccaaatactaatgaagccattgacattaaaaagctactaacgcaccaaacaacgcactacctaactttaatggaaaaaaaaaatcgccctaaaagg

SEQ ID NO: 7451 - DNA, 358 bp, Bacillus thuringiensis
aaaagcatgagctgctcaacactgaggagaatcacatggaatgaggcgtcatatttaggaggatttagcccgattatacttgatgatagcgaacaaatatagaactaagctatctaaaacactatacggaagagacactggcgataaccggatactatgtgcaaatttcagactgttggaggaacctattgaagaaacaattaggctaaaagagttatatcatatcgtaaaaaaacggctagcaatgatcctgggaaccccctccggcgcagcaatcgtaagggctatcattagccggttactatatgacaccaatccatcaatcttagacacaaattattgtgactgagaacaagca

SEQ ID NO: 7452 - DNA, 199 bp, Bacillus thuringiensis
caaggggtctccgtttgtaaacccaaccaagaaaccagggggcttgtaaattttaaattaacaaccggacctccaccctaaccaataaagtctattgtcccatagggtaaaccaatgactccaaccggatctttagccaaaaaaatccaaggaactatagcaggaagagcagaatccaaaacatggaaaatcaaaaacc

SEQ ID NO: 7453 - DNA, 142 bp, Bacillus thuringiensis
attcgtgattgatgagtgtcaatatttggttctacaaaggcatgctatctatgcggatcaaaacatttaggagggtgttgtatatagaatgaccaacatgttcatatgctagatgtaaaaatgttgaatacattgctaagaa

SEQ ID NO: 7454 - DNA, 217 bp, Bacillus thuringiensis
attactacaaaccaattttttttggtagagatatcaataactgggtcgggctctatagagaataagccacccccctcctatccatatatttgtgcttctaatttcactcttgttacaaaattcctatacgtacaaatgattgacctttccatttataatacttccccataatctaaagagttagaccaatccgcatacaatagactattaatgcctg

SEQ ID NO: 7455 - DNA, 137 bp, Bacillus thuringiensis
taacactgggtcgaccaattcgcaacggctttttttagagcggcgcctaccaagcacaggggggaatttttactgggggcaacgattcacaattacttcgacgccaagatgctaggccagcaaccaaaacttcgcat

SEQ ID NO: 7456 - DNA, 189 bp, Bacillus thuringiensis
agcaacacgtttttctactgaactagggcacctccccgggggggatttatggggaccagggcggtaacaagccactcaccactgtacggcccagctgatggcgatattccagccaccactgatgagagaccagcatcttacacctggatgatcacattagcggacagaagacccgaccggaccattaat

SEQ ID NO: 7457 - DNA, 676 bp, Bacillus thuringiensis
  unsure (1)...(676): unsure at all n locations
gacggctcaatgcttgcggtgccgctctgacgcaatccctgcgcttgtagcgttaggatatacgtatcggagtgcagcctcgatttatctctataggaggatgcgtaactttgctcggtctagtactgaatatccttcacttactcatcggagtgaactacttggcctactagatttcaatatatcattggaggttactgctactttggggcacgtagccgaaataccgtcaaccgaaatagctgattcgaccctgatattccccctcttcttggccggcggcgaggcgacggaggccggggaggtgaaatttgtgcgccagcgactacaactgatgttcgagaagcggcattttcagaatatctcgcgagccttgtcactccttaaggaagtctgggaccgccgcctgaggaggttagatacaccggacagcgatgattcagattggcaaaagatcctcgccagtcaaagctgccgacttctcttaacataggaatcctttgatccagctattatatttcggagcagccttctggagtagggctttcccccctctccctaggcctngcactttcatttcatggggactcataggctctagtgctatattatgacagaactccggctaaatataagatttcatttgaaaacaatggacttgctagcaccgtgaatc

SEQ ID NO: 7458 - DNA, 401 bp, Bacillus thuringiensis
cctaaacgcctgagtccactaatcactgaaaacgccatagacttcactatcgatcggcaggagcttgcctgttgtggataaattactgccgtcggaagcatcgggcctcgctgtgagacgggacgaaccgaggacagcagagcacaggaagacagtggcgctatcgcttcttgcgaagaccgtgatcgcgagatgccttgtttggaatgctcattctccaacctgtcgacctgcaattgttcagagtgaaattcagatgcttatcggcctatatgaaccgacgaacatcctgtaactagtgcacattgcactatgacgcctaggccgcagagggcgcctgcgcggctacattgcctgacgaggatcggatgatcctataagaaggacgacgtttacgacgc

SEQ ID NO: 7459 - DNA, 186 bp, Bacillus thuringiensis
ttttgtttctttccctcttatttacaggaatatttaaaatacctgggggtggttatcctctggcataaaaaccgacatttgttttggaaactgccgtatcaataaccgccccggcttgattgttaagcgacacttgagagaggtactgctcatttcaacctttatggtgccccacttaaagctaag

SEQ ID NO: 7460 - DNA, 147 bp, Bacillus thuringiensis
tggatacttgacttttttttacgacctggaaatatgcgttctcgggggatgcacaagtcaccatggctgcacctcgagcctctgaacctgatcatgtttcagggatcttactagcttacgctgtgggaaattccattgtgagggggg

SEQ ID NO: 7461 - DNA, 388 bp, Bacillus thuringiensis
atttgctgctgcatccggctgtgctgacatattttctcttccgggcgaagcggggacatcttgaggggggtttaatgtgattaaatatgtgaatacttgcacaaaaatttgaaaacatgtttttttcatgcgtcgcataaaacctttggtttttattttgtaaaacgggatgcattttgtgcactggatggggagtttttgaattccaatgcttggacttttaaatgaacatactccttgggactattatgtgaaatttctaaaatgcatatttggtgtctgtgaccctaaatagagattggccctggcatatttttcacttcttaacatttacatgggatctaaaattcttttgtttacttaatggactaacaggttttaatggtgc

SEQ ID NO: 7462 - DNA, 120 bp, Bacillus thuringiensis
  unsure (1)...(120): unsure at all n locations
gccccacggcnatccttacgcgtaagagtccggggggaagggcgctgattggactcggggtcctgagaggattaccgaatggacgcaatctgcgagtggcaaggactgatccttaggagt

SEQ ID NO: 7463 - DNA, 489 bp, Bacillus thuringiensis
tggcccgtgataatcgagcttatcaattaccgcgaacctgggggcatattgctctaagtctaagggaaccctttatggtcgcaaaaggaccatacggtactggtgggcattttgcagccgcagcattgactgactgaatcgcgcggacaggtgcttctttatgggcatacgagggagaggatcgctaggatgattactttgcacatgctggatgctgcgtgccaactataaactgtacttccgtttgcgcccatgcacctgcatgcgtgacaacgccgcctcatgtatcagacactgcgcgcgcactggactccacggttgtaggcctatgcagatgacgctgatgcgattcggttgatttgtacaagacgtccgtcttacgggtaatatgttatcagtaaaaacgctgcgtccatttgttgatgacttaactggtctaaagaagattataacaactgctccgcttgaagaatctgccgctcctcaagt

SEQ ID NO: 7464 - DNA, 389 bp, Bacillus thuringiensis
ttgggttgctggtctggaacacgtaccgtttgtttttatgctgaaagatggtttgagatggcagccgcgcccaggaagagtaatacgacttgaagatgtacttgtagaacctccggtgctggctaagcaaaatgttgtggagcgaaattccaccttagcacagattgaagaggtagctcagcttgattgtggtgcggcgatcctcttacacgacataagaattgtgcgtctgcataagattaggactctcagtggactcatatgctgaaatttgatggacaaacgggaccttgcgtacggaacacacatgcacgtgctcgctctatatgaagaagagaaggtgctgaatttgaagcatgtacatttgctggaaggacgatcatagcatg

SEQ ID NO: 7465 - DNA, 133 bp, Bacillus thuringiensis
gatttacagtacatagtgatgcataggttgaagtgacgatcgcagcagctgaaaccgcaatgtcaaaatttatagcgtaatgctttagagaaaaccggtttacatagggggagcgatttttttaatcatgaag

SEQ ID NO: 7466 - DNA, 319 bp, Bacillus thuringiensis
ctggaaagtgatagggacttgatggcgcgttagcaaagtgttgtgataatgaacagggtgaaagcatacgtgtggcaacaatgacccgtttgaacatgggccacatggcgaagagactcttggaaccggtagtttcaagcttcaaatgactgcagagactggatctatccagatgaggagaccttggcttctcagcacgtattgcgacgacgctctgggctttgatctgtaagaactctagctgcaacacggggaccaagcggctgcaatgcacgaaggctagtaagaaccttgagagcctgtcattctgtgccatggt

SEQ ID NO: 7467 - DNA, 116 bp, Bacillus thuringiensis
acattattatcaaaatctttatttttgactggtgtgttagtataaaataaaaaaaccctcaaattaggtcaattgcttttcaaatacaaaatctttatttttttaaataacctatg

SEQ ID NO: 7468 - DNA, 406 bp, Bacillus thuringiensis
gctcctaatgggaacccgagtactggacaaagcgtctacatgcatggccagactagtgggatcacgccggtaattttaccgatgttgggataatacagacagccgcgtatatatattccttggctgcttcgattacctttataacatctggtgtagtagtatcagcttttaaaagtgtatgggcaattaactttgcaatggtcattaacttcactccttatatcttttaacagcttcattctaactcttagttgaacaaatgcaaatacacttttgaaacttcgttcattctttttaaaaggaatcatcttgtaggaaataaagggcattctaacatagaacattttagatgtataatcaaaatttgtatgttaacaatggtagggtgtatcctcatatgcataat

SEQ ID NO: 7469 - DNA, 177 bp, Bacillus thuringiensis
gatttactaacttggttcactatattgcgaaaccaattaatctcctgcaatttctagtttctgtggaactattcaaccattgaggattgtatatcccattgcacactttctttccattaccactatttcgtttcaatcataaacattcttatcttattttctagttttccacacata

SEQ ID NO: 7470 - DNA, 278 bp, Bacillus thuringiensis
cgcttcccgatttcgtacaatcaccagcagtaaacccaaatgggggggatatttaacaaattgcgcggcaatcacagaggctcggtattcacgcaatggaagctggcttcgcggcagcttccgaaggtgacccttcagtcgcacaaacataccagcaaatacaatcccaacatgcaactaaaaagcatcctactcgggcgctagatagtgccatactatgagcctaagcaggtgtaaccagagctgcctctggacctgcgcccacaactccagctact

SEQ ID NO: 7471 - DNA, 316 bp, Bacillus thuringiensis
caaacacattatagcatcacgcaacgccatgacgtaccggcgggataattgaagacagcaccggtttagaaaacacggaaagtgaatacaaagaaccaaaatacacccgcttagcagacactacgagagggacaaagacgggatagatacacaaagcaggcaagtcaacatggaggagaaaaacgctacaaacataaaagataggttaagcactctgccgggaacaaaacaggggatctccacaattcaaatcatgccggaaactaaaggcacagccaaggagaaatacagggagcgacttacatgagaacaccaa

SEQ ID NO: 7472 - DNA, 146 bp, Bacillus thuringiensis
tgcgactaaagatgtcttcggtggtgcttccggaacatcatttggtgtatgtaaagctgtagacagagtaaaccgttctcacattacttctcgtagcacctctcgttgaaagacactatttttagaatctccttgctataatacga

SEQ ID NO: 7473 - DNA, 461 bp, Bacillus thuringiensis
  unsure (1)...(461): unsure at all n locations
cacgaagccgtgcctcagcaaagcctcttctcaccacagggtaaattcatgggcatagccagcacaatctaaccacttacctctggcaatcaagatgaagttcctgccacttgaaagcacactagttgtgattgagagccttgttcttgttctggccttggacttcgagccggatacccagggcttcaatgtccatgactatgttagtctccttgaacaaccagagcgcttcttctgacatggcatgcgcgtacaggaacgcctccctctgacgctagacctggccacctcccaagcgttgtcgccgcagctggcaactcatggtgggcatcctcgtacatctacgccttagacaacagaccctacttcatcgtctcgcatgtcggaaacccagggccccggtactatagatactncatncttgacgtcagcaatcccagttactaccggcaatatgcata

SEQ ID NO: 7474 - DNA, 115 bp, Bacillus thuringiensis
agacgctgtacggaaaaaccccagaagacgagaccggacgcgcagaaaaggcacaaggcaacgaattataagcgcaagaagaagcaaccgcaccaggggaagcagacagaacaca

SEQ ID NO: 7475 - DNA, 247 bp, Bacillus thuringiensis
ccgatggaaagggacgtggaacacatttatcctcatgattccatgcaacaaggtgaaattatattgtgaaactttcaaacccataacgtggacaggcttcagcaaactgtatcactgtatgcatgaagggcatactggcgcattcaatctgggagactgtggtgccgaaacacgccctaggcggatgtgaccaacttgcaacaggaaaaactttctaaaaccatgcattaaccaattttattgcttc

SEQ ID NO: 7476 - DNA, 135 bp, Bacillus thuringiensis
aaccacagaacgagaggaaacagaaaaaagcaccaattgaaaacaatctttcttacgaaagaaaaggaaaatgagaaagagggggaaaacaaaaaaggacacaagaaacaaggaaaaaacccgatcccaaaacaa

SEQ ID NO: 7477 - DNA, 362 bp, Bacillus thuringiensis
aattcgagatagcttgactagtgttcctaacccgacagcacgttattcatccaggcagtacggcattggtcgggggcattaaggattgagctgggttcactcctgcagcgagaacgagtacgcgaattgcggcttgcactgtcgggcgagctttctccttcgggatcatgaaaaccaataatccatgcttattacgactaggcagccagcctcaggacaaagcctaaaaacgcgagggattcttcttctaggccattgaccatgtgagtctcatccagattcagttcaactccacacggctgaaactgctcccacagacaatgtaaaggcagctgaggccatccactcttactggagtgtcc

SEQ ID NO: 7478 - DNA, 165 bp, Bacillus thuringiensis
aattagataccagttttgttagtccaggctcaaggaagtttatgggtggggacgcttagcaggaaaaggggaacagggtaacgggaatgcaagagacttattacaattaagacgacgaatgcttgaaggaccagctattttagaagcaattagggtggtagacaa

SEQ ID NO: 7479 - DNA, 327 bp, Bacillus thuringiensis
catgcaatgcataatttagcagcatattctgatttttttatttcattattatctttctatgggtcagcagcagcagtgttaaacacacacttcggaaaagttgttttaccagttggaaagccgtttggtatttttaaaaagtaataaaaaagcacagatgattgtatagtcatctgtgcttttttatttattgaaagctatagcagtcgtccttgttaattcagaaattttttgagagctcgcagaattaccgactattgttacatgaacttgttgcttagggttcgctgtaactacctatgcgtttggtaaatagcgtgatttatg

SEQ ID NO: 7480 - DNA, 138 bp, Bacillus thuringiensis
actgaatcacatactgtaacaataccttcttcaagaagcacacggcacacaccactaatacccgccttattttgcgttgaagttgtatataaaacatgttgatctacacttaagtctaaataactacttgctttctgc

SEQ ID NO: 7481 - DNA, 153 bp, Bacillus thuringiensis
gcgctacggcggcttatttttttgactccaccagcaatttagtatggggccatcatgagtggaatcacctcgaaccggatataactgcctattgcttactgtttacatccagcgatgtttcattcgtttaacgattcaaatcagtccatctcc

SEQ ID NO: 7482 - DNA, 224 bp, Bacillus thuringiensis
agaaccgcacaaagcccgaggggggaataaacaggggaggacgcggaggccacacggcaaagaacccacaagggcaacgagaaacaaaggccagagagcaacagaaggaatggagagcccggccaaaaaaacgcacgagcaaccgaagaggaacaaacggaggaagaaaggccaggagaaggcgaaacaccgaaagctaccaacggaccacacacacacagcga

SEQ ID NO: 7483 - DNA, 103 bp, Bacillus thuringiensis
ggttctccccttctacaaatttgttttgtgattatatcgctcgccctctggggggaagtgcagaatcgattgcatactgcgatgcagttgaactatgaacgaa

SEQ ID NO: 7484 - DNA, 182 bp, Bacillus thuringiensis
taacaccctggcaacaaattaacataggccgtttttttcgaggcgttttcaacgcacaaacggggggttcttccgggggcaccgagggataatctttcgtaccacactatgcatggtcagtacttcaaaaagggccctcaaaccgttagcacacatttcattacgagacactttgaaaatac

SEQ ID NO: 7485 - DNA, 450 bp, Bacillus thuringiensis
cacccggatcttctgccagaaaaatatattgcttaaaagagggatattttactttgaccgggatgtcacctacttgattgcaactacaaatgtaaggcgtacaagttacgtctgtaacaacgatagcatactccgttaacatatgcccgactcgtattatatccaaaggtgcattacttgtatgacagaaagatcaagatgtagactttgaatgaatgccatgtgaacctcggcactagtcgtatgctcacatagatccatataatgatcccgtacaattaggtaccggggatgcttccattcctccgacagagaagaagcttgcatatgatattctcttcacaagggtctcactcgatccatttactcgtctttgtattgatggcatgcaattgggaaacaatcgtgtactacgttaccattagcatgaccgcacttgcactgtcattt

SEQ ID NO: 7486 - DNA, 192 bp, Bacillus thuringiensis
tcaaaccccggcgacatattaacacaagccacttgtatcgtaccgctctcaaagcaggaacagggggtcttttatgtgacaacacgggatactcctctggacccctcaatgctacggtagcacttctgaaatataccccacaccacatacacatttatcatcacaaaacaccgcaagacctgcaacatcctt

SEQ ID NO: 7487 - DNA, 177 bp, Bacillus thuringiensis
tattcttcgccataaatcgacatttcgcgggcgaactgttaatatatatagggatacagtagatgtgtgtgaagaatggtaggaatatctctaagttactgcctgatataactgaggaaaatgtgttccgtttttatcacacaggttaataagattcgaaataatgctgtaccaata

SEQ ID NO: 7488 - DNA, 193 bp, Bacillus thuringiensis
ctcccagctttttttctacacgaacatattcctccacagggggagcattttccttccaccgtcagagcgccaacattgacttcacctaccaatgtaaggcgcccatgttacgtgcgcaacaaaaatagcatactcagttaacatatgccctactcgtctaatcgccaaaggtgcattccatgccgaacccaaa

SEQ ID NO: 7489 - DNA, 509 bp, Bacillus thuringiensis
tgcaatgtgtgtctaagaaatattgagttatgttttgtgatacagatgttccgtttttctgtttctatatttacctggttggtatatggcgtttgggtaggtgaggatcatttattctctttcggcaggttgcatacaggatgcgttataccatcatatagggtctggactgctgtttgtcatgatattatacccattatatcctcgaatatttcttcaacactatgcagtgcctacgtagtggatagagtcacctgactaaatcttatcatatctaatccgctgttgctgataaaaggtggaaaaaattcaaggtcgcagcgattcataactacaacccctcactctcgcggctctctcaattatagggttccgttgactataagaacttataattgcataatttcttgatcgaaagatttccgcctcatttcagctccatagctgcggcagaccagcacgcaattgcaaaaatcagttcaattcaatatatcacccgcattcagact

SEQ ID NO: 7490 - DNA, 397 bp, Bacillus thuringiensis
tgcgccacaacgcgacgcttctcttggccgcggtatagaccgtgttttaaagcattggggccaacgcaatagcattgaacatataaaaagagtcataaataattcatgtggtgagattatcaatggcgtctgacgcggagagaggtttgtcgttactcatgccttggttgagaagctctactaacatgggacgagatgaaatgaggccgagcaatctgctagatactgttgagcatctagaagcaggtatgtttaccacaatacgtctgagttagcctttgtctgagcaagctataactgtagttgctttcgtgccgccgagacagcgttatacggatgccggagaactggccaaacagatagcggaattcgcatatgagagcgggaacccttaaac

SEQ ID NO: 7491 - DNA, 127 bp, Bacillus thuringiensis
ggaaaaacgttttttcacagaaaaaggccatatcgctgggagggacatataagctaaggggcagtaacaagcctaaaaccgataaacggtcaagttactggcgttaaaccatacggtactataatca

SEQ ID NO: 7492 - DNA, 161 bp, Bacillus thuringiensis
gcctgcctcattgagcttaatgacagcggttcgttatacgggttaccaaaaaacatggaacagatgatgctgatatcaataaagtgcactatcaccggatggtcgacgagttatttttagatgtaagcgatcacctaaatacatgagcgtgagctgaactg

SEQ ID NO: 7493 - DNA, 185 bp, Bacillus thuringiensis
attaataccggcgcgaacaaaagcaaaagcccttttttaatgaggcacctaccaagtgctaaggggtatttcttcaggatgcaggcagcaacatgcaaacgttcccccagataatggcgtggaatgcgcaacttggttttcatgatgtgggaacggctatgtctagccaaccaccgtgagtgtca

SEQ ID NO: 7494 - DNA, 192 bp, Bacillus thuringiensis
atagagcgtggcgaacaaattgaaaggtgcttttttagtgcgacatgcaacaatcactgggggggaatttttcagagtgcacggtgtttcaactcaaggtatgcaaatctgctcgcctcgcttgcccagcagcctatctatgattctcaaaaactactcacagcgaagcaccgttagtttaaatggacctac

SEQ ID NO: 7495 - DNA, 177 bp, Bacillus thuringiensis
caacaacatggtgcactattaaacacattcttttttaaacccgcacggaccaagaactaggagggatttttccataatgcacggacctacatgcaattaatcccccagatgtagccgccgaatccaccacagacaattcatgatacgtggacgctaacactggcccaccacggttaa

SEQ ID NO: 7496 - DNA, 180 bp, Bacillus thuringiensis
aaaaagcggggggcccaaatggccacgccctctttcagaccgcatccaaacaaccacagggggggacttttacggagagcaacgaaacacagccaaagccacgcaaagacgccggaacaccaaaaccgacatacgcagcccgaacggcaggaacccatccacaacacggaaggaataaac

SEQ ID NO: 7497 - DNA, 227 bp, Bacillus thuringiensis
caccctgctttttctctacatgtacatattcccgctccggggggcattttatcggcatccgctatagtgccaacttgatcgcaactattagattaaggcgcacaattaaattgggatacacatcttgcatctttctttaactatagcatttcccgtcgaaactccaaagatgccttccgtcactatactcgaagaaagctacttacctatacgctcaatcccacatc

SEQ ID NO: 7498 - DNA, 105 bp, Bacillus thuringiensis
acacatcatcataaaaaaataaaaacagcctttttaagcgatacaccaaaccatagttagggggaatttgaacagtatgcagggaaacacaagcaaatgatatgc

SEQ ID NO: 7499 - DNA, 144 bp, Bacillus thuringiensis
caacggcctccttacccacagagaaaacagattcaggggggctttatagaaaagtctgtgagcaatccccactttttgattaagcacatacactaatcctcaacattcaatctgttttacaaaattaaacagttaatattacaa

SEQ ID NO: 7500 - DNA, 181 bp, Bacillus thuringiensis
caccgttcttctcacctggaagaacatatatgcgaagggggatttatagaatgggtaccggtaaatcaccatcttgaaggcaactataaatagaatgcgcctaatgtgacttgcgttacaaaactagtctattaatgtaaacaatggcaaaccacgactggacatataaagatgcctgcct

SEQ ID NO: 7501 - DNA, 189 bp, Bacillus thuringiensis
gaacaacggggcgaccaatgagaatcggcttttttgagagcggagcgctccacgcacgtggggggactagtactgacggcacggttgcatactctacaggaccccaagatgcatgaacagcagaatagaaagcggttcccgcccgattggaaacaactgattacgaaaaaccggaagagcacccgaagc

SEQ ID NO: 7502 - DNA, 193 bp, Bacillus thuringiensis
ggtatgagcgtgctacattttcgtgtcgcccttttttttttttttgcggtattgcgccttccggtgcgtgctcactccgaatcgctggtggatgaattagacgctgcatatcaggtgtgtgcactagtggttttcattttactggattcaatcagtgttgagatcctagagagttatcgccccggcgtacgtt

SEQ ID NO: 7503 - DNA, 164 bp, Bacillus thuringiensis
ccgaacccccttgcccacagtcgcgcagcctttttgagtgatgcaaattgcaagcgcaaaggggaatttaaacagagagcgggcagtaaggtgcatcagttcataaagaaaccagtggggcaaacgcggcataatcccttagaaactaaaacactagacctagc

SEQ ID NO: 7504 - DNA, 192 bp, Bacillus thuringiensis
tcggatcacacttcgtgattccaaccgggcgccctatttacatcggccgttttttttttatcgcacacaaagcacgaacgggggggtatacaggaagcaccgcgggataatcatccgaatccccctatgcttggtctgcactcaataaagcgacctcccaccttttgagcactagttcatcgcagaatactg

SEQ ID NO: 7505 - DNA, 228 bp, Bacillus thuringiensis
atccgttgctatccccccgagaatactcattccaagggggtattatagtgtatgtcgcgttacatccccatcttaactgcaattttgaattagtggcgaccgagggatttgcgacataaatccgtacgactccgtcagattaccccctaatggataagacccacaagctccgtgacgagtaccaccgtacaaacacgccgaatcaattgaggacctacgatgcactct

SEQ ID NO: 7506 - DNA, 116 bp, Bacillus thuringiensis
aagacacggcacctccttttttttatcggaaaaacgtgtacggaacaagggctcgttttaaggctgaaaagaacgctaaacagttggaagggcctaagagacgacttgggccgact

SEQ ID NO: 7507 - DNA, 200 bp, Bacillus thuringiensis
aattcgggatacaccctgtggcgcacaaataagaaaaaccttctgtttactcgcaatgaaaaagcaccaccggggggctttgcctaactgagcgttacctaacaagctttacagcgagaaatgagggccgtacttttagaatcgccccacatcctttactgctcacgtcatcatgaaatgcggcgaaaagagattgagta

SEQ ID NO: 7508 - DNA, 189 bp, Bacillus thuringiensis
tcgggattccgcgcaggccacactaattacaactgccctttttttttgttcatatacacaccaggttcggggggttagtcagtaaataccgggcgagaaccatctcccacgcaccatgcttacgcgggttttacctaagcgacctcccatcatgccagcacagcccttcaccgtatactacaaaaaagg

SEQ ID NO: 7509 - DNA, 556 bp, Bacillus thuringiensis
accgacatcgagtgacgctggttagagtgggacaggagaccgaagatgattcttggaaacgggtagagaaagctttgcgtcaaagctcaaccttgatcacattggcactgggaggtgtggtgccgctagcttttgtgagaaggacgggtgtagctgcggaagacgacgcttaaccttgtgtatgccgctcttccagtaattaagagccactctaatcagttaagtcatcttgctttagaaactccccgaatacaacactctttagcatccgcgcagtttggggatttgacatatgcgccgaagcccatcgtcggcaagaaaacaggttcgaaggcggtaatgcgccagcgaccgacattggtagatggatgtagcgcgtggtatatttccatggcttgttaagaccgttaggttttgttcggaaagtaacggcatggcgagagacgtcaccgttaacccctggctggggaacgcagtggaaatcatggatccacgcgtgctcgcgtggaagaatatttgccgctagtatttctctgtaggtgtgccaatggctttc

SEQ ID NO: 7510 - DNA, 117 bp, Bacillus thuringiensis
caaaggtttttatccttgcgaaaagacttacccaaaggggggttcatagaaatgatcccggttcaaccccggattgactgcactatcgaataggtgtcgaacgattgaagtccaata

SEQ ID NO: 7511 - DNA, 288 bp, Bacillus thuringiensis
aggagtttcctctcagcacaaagaacgaaacttacgggggggttaatcacagatgcacacggatagtaacgaagggacctacactgtaaatgcaacacttggaaatgagtatgaaacttgtctcctggcttgaagtgtacaaatatcgcggacaagaagtcggacaagtttctcaaaaagatgcactggaaagctcaacaacttcgtctaaaagaaaatgaacgtttgggacctactgttttagattacgatagtcacgagacatatgtattccggactaccagaaga

SEQ ID NO: 7512 - DNA, 249 bp, Bacillus thuringiensis
gacccgggtcctcctttccacgaacatgcagccccaacggggggtattttacaggtaccgctagagggccaacctgactgcaaccacccaatgggaggcgaccaagtgacgtgcgtgaaaaaacaatgcggatgacgagaacaaatgccctgctcgtcaagaccacaaagatgcatgacatccccgactggaagaacacgccggcgcctcccgagacaataccacaccaacgaccgcctacttggacgg

SEQ ID NO: 7513 - DNA, 259 bp, Bacillus thuringiensis
cacccggatcctcttccgcaagaacatataaacccacaggggggtattttacgcgcaccgctggaacaccaacttgactgcacctactaatgtgaggcgaccaactgacgagtgaaaaaaaaaatgcatatgcagttaacaatagcacgtaacgtcaaatccccaaagatgcataacacccacgactggaagaacacgaggtagactactagagacaatgccacatgaactaccacctacatgatcggcttacatactc

SEQ ID NO: 7514 - DNA, 248 bp, Bacillus thuringiensis
cacccggatcctcttcaacaagaacataatgctcaaaaggggggcattatacgggaaccgtgggaacgccaaacagaccgcaaatctcaaaggaaagcgaacaagtaaagagggagacaaaaatagccaactccgttaacaaaggcacgacacgtcaagtctccaaaggtgccaaccatcaccaactggaagcaaagtacgaacgacatcgaagcaatgccacacgaacgaccgccaacaagacaggc

SEQ ID NO: 7515 - DNA, 128 bp, Bacillus thuringiensis
gaacaactgggcaaccaaagaacataggccaatttttttgaagcgcttccaaatcacgaacggggggtaattcaggtaacaccgggggatactccatagtatcgcacaatgcatcgctagtatttcaa

SEQ ID NO: 7516 - DNA, 183 bp, Bacillus thuringiensis
ttacaaccgggctacctcttaacctaacccattttttttgcaccgaactcaccaaacaaacagggggtattacaagaaacaccgcgggataatcaaatgaaccacacaccgtttgtataggacacagtaaaaggacaaccagtgactcgcactcaacccaatacaaaatactgcacgcccaca

SEQ ID NO: 7517 - DNA, 322 bp, Bacillus thuringiensis
aacgctcgggtactaatttttttcttcggaaaaaccttttccggacaaggcctcgttttcagggtgcaaagaacgataactagttctaagtgcgttcgtgacgttcttggccgacccatcacggattttgtctggaggagcaggtccaaggagcgtatctcctgtggatgtaacagatacctagggcacttgcgtatttttagcttacacgttatactaagtattacaaagttgtagcacatctgactatctaataaagagcagctcgaggaacattctcagttacagtatgaagcactactgtttgtgctgtcgtgctcgc

SEQ ID NO: 7518 - DNA, 153 bp, Bacillus thuringiensis
ttttcgcacttactgtccgaagctgacatgggtaacttagtatgacactgtactgcctgacactttggtaaagcggtatgaggagatgtagagcttgcaatcagtactcattaatgctcttagtgacttatactttatatgcatgttcagaat

SEQ ID NO: 7519 - DNA, 189 bp, Bacillus thuringiensis
gtgatgcacaaccgggcgacatatgagcttcggccactttttttttggcgcgctcaaagcaggatcggggggggggacatggggcaccgtgggatattcctctggatcccactatgcatgcgccggactcaaaaaaggggttaccaaccactcccacactactcatcgcacgatactgcgagtcaacct

SEQ ID NO: 7520 - DNA, 194 bp, Bacillus thuringiensis
ctcacggatccctccttacaagaacatcaaacacaaaagggggggattttacagggaccgtaggagcaccaacccaagatcacctacattttggcggcgacccagcaacttgtgcaaaaacaccttggagccccagcgagcaatagcactcctcgtctaatctgtaaatatacaaaacacttaggactcgaagc

SEQ ID NO: 7521 - DNA, 348 bp, Bacillus thuringiensis
ggatagatgcttgtctttacacgcgttgaaaggcgcgccccagggttggtaaaactccacaagactgaaagcatgctagacactatccgttgtcctatttgcacaggcgtgttctgcgtgctcatcactgtttaatatccgtgcccctactggttctatatgaccacctatcattcttgtttgcgatagggcaagattaggcccataaccagtaagcgggcatggacgaaaattatttggcgatgctacgtcaatggcgcaaggacgactaaatctacacttactttgaaggaggcgaaaacgggccggactatgattaacccaagagtcatgtgcggggatttgcac

SEQ ID NO: 7522 - DNA, 396 bp, Bacillus thuringiensis
ttccatgttgataacataacatgaaattatcctttttttgatccctaccacaaaaactaaaatctgggcatactgatccagataacactacttactcgataaacggtgatgcaggcgtattcctccaaattctagacactgattgaccacttgaaaagaatccatggatatcgcacgaccgattaactcctttatcaagcgtgacggcgtgtgtacagacaaagatatttgaaataaattgccgcgaactgcgattatacacataacggatataatgaccaaactgtattgtgaaaaggcgagtgcgcctcggagtttaacgttattctatggcgagagcttggtaaaggtcactatcatatggctcagtgccaaaagtgattcacttagcaccaa

SEQ ID NO: 7523 - DNA, 107 bp, Bacillus thuringiensis
ccgtgatctagggatacccagttgctgggcaccaaggtagtcattctcaactgagggcccaccgacggagggtctttttaacgcgctctctggaagggcaacctgcc

SEQ ID NO: 7524 - DNA, 183 bp, Bacillus thuringiensis
agtccttattccatgcttgttattacagctccataaacatgactcctgtgggtgaaatgctttttatgagagagaaacgtaaacaaaggaaacgcacctactactgtcttgtactaggagtctgtaagctacgaaacgttgttgttaccattattctcatgcccattcctacaaacaacaata

SEQ ID NO: 7525 - DNA, 398 bp, Bacillus thuringiensis
tttttctgggttcccgagctcaacctcggggggttttatagtgactgggggcgggtcgaccctctcgctgctcgctatgctcccgcgcgtcgactgtaaaaaccctggcctgacctaccatattcgcctggtggaacattccctttaaggctggtatcctctgttctaatagacccatactctgccggattgacaactgttgagcaaactggttggtatttggacctagttcgcgtgaaatttttgctaatatatcggattatttcactcttaagccgctctcaatataaccacttggccatattcaggaaactccctcatagtattgatgattcgtccttgttggggccgaaggatactctggatggaatcaagctgccaccatactggaacataaa

SEQ ID NO: 7526 - DNA, 208 bp, Bacillus thuringiensis
tacaaaagcgtacaggaatgcacattacacaaccgtatgtcttttttctcagaacgtcctattgcccgcatctgcaaaactgacacatcttaaactgaactcgactttgacatacatcatccatcaaccaccttttattagaagccagtatttcctgtgtaaggtttgaatatcggctaatgaagaccaaagtacaatgaagttgaat

SEQ ID NO: 7527 - DNA, 197 bp, Bacillus thuringiensis
aaagaaattttcctagatctgaagaccatttcgaggatactccagtgaagcgcaccatctgtttttcgataaaactatatatggcctctaaatctggaaccgcatataggagccccttcctcgctttccaataacctgctagcaggtaattgaagatgtaccaatctctccctttacataaagattctccttaccca

SEQ ID NO: 7528 - DNA, 233 bp, Bacillus thuringiensis
gtctatcacgaatactgtatccaatccgacacgcgaatgcaacttgctcgattgctagctgctcctatcgtgcacgggatataagctagactgcagcaaggatataggtgtcacctgggggaagttgtgggcagctcacaacagcatgcaccaagcgagccttaatggtaaagacaatggtcggggaagccgaatccgtgacctgactgaaaccggttgcgttagactcgctg

SEQ ID NO: 7529 - DNA, 185 bp, Bacillus thuringiensis
gccccacaatagtttccacctgaaacgctattgaccgggggggtgtaattgaagaaggctgttatccccttcatcacgaggggttccaacagaaacgtggcattacaatgtatcggttcgccatgagtgagaaggggctaccttcggcagttctaaattcaaaacataggttaactaccggcccc

SEQ ID NO: 7530 - DNA, 419 bp, Bacillus thuringiensis
gaaggggtgatgcaacctctttatctaattaagcacgcttcctccgaaccatatacacatgaagatctagggggacttttagatcaaatgccggacttctccccaatccctttaatcatataaaaagggaagccaagctattaaaaaaacaaagcccgctgcaaggtctctaaagcttcatcggaagacatacaaaatccagacccagttgcctcgaatggggaaaacaacccaagtccacacgaaaagatgcagggtgcgcacactaataccaactaaaacagcttaatgcttctaccctcactgccatctggttatacccccgagcacaatacagataaaataggactcatcgttagagcccataaggaaattcagttcatcttaaaaagtcccaccccccctatattacacgcaaa

SEQ ID NO: 7531 - DNA, 114 bp, Bacillus thuringiensis
ccccttttcgccagctgtttctgaatccaatatgatatacaccagcaacggggcttacttacgcatatataggacgggcaagaatcacgttcgtagaatgattgtttgcggata

SEQ ID NO: 7532 - DNA, 118 bp, Bacillus thuringiensis
tagggacaacccccatcctatctttaacgttacctaaataacgctgcttgagggtgatttattatgaactattacctacagtctaaagactcctgcatgacagacatcacactttcac

SEQ ID NO: 7533 - DNA, 265 bp, Bacillus thuringiensis
ctcgttgagccagcatatgttgttgcactcgtacagaacaaaactccccaaacggcgaatttgtacagaccaagactaaacattcctcgcaggggtgaaggtgacagaaccctacatagaataccctcgcaggctgttcagatacgcttgcggtgcggccttcgtctgtaagggtaactcggcttctgtgctcaacgtactcgtcgattaccttatctagcgcgcccttagattcctctacaaacacacggaagtaacactcttc

SEQ ID NO: 7534 - DNA, 231 bp, Bacillus thuringiensis
ggcaggagaagcaagccggccaacgaagacacaaggccttgattaccacaaccccacaacacgagcaggggggcacattaaaagcaaccgaagagaaaccacccacaggagcaccagagaaagaaagaacaaaccatcgacaaaaacaagaaccgccgcgccgaaagacgagcaaggcccacccaaacgaggcctggaaacaaaggggacgacgagaagacgaacggcaac

SEQ ID NO: 7535 - DNA, 153 bp, Bacillus thuringiensis
  unsure (1)...(153): unsure at all n locations
ttctacgatgtggcccaacttagtgatcggcgacatcccgatnaatactgggggggattgtgccactcgcatccctgtcacccctaacaccgagtattattatcggccccatccatatatagactccgacagaaaaccccctgcctgtcaatc

SEQ ID NO: 7536 - DNA, 285 bp, Bacillus thuringiensis
gaaccaaagccgccatatgaatgaacagccgctgtttttggggtaacattgatgtatggttaacgcttgcaggtttaacacgccatacatttgaacgatggatcgcaatacacacttttttacatgactagacttcggggagtaatatgctccttaatatatcaagggattcacatcgtctacactctaagtagtaaacacagcttcattcaaactcggcatacggtagagaaacaacaccgattcgagggtgagatgtgtacgggagcttagtaccgtatggtg

SEQ ID NO: 7537 - DNA, 336 bp, Bacillus thuringiensis
gaaaactgagcactagatatggctacgagaagcaacatatgtacggcggccaattctttatcgcgagactcttactagacgaacattattcttaacgctacatgatgataatcaatagcgaataaagctactgtatcgactactttgccaacacaaattgctatccaaaagcatccgctatacccattgatagaaggtttacactgcaagtaaataacagcagctcttctctcgacaaagacacactatactcaatgtgctgaagatcaagcgaaaggatctacgacattctggtgaaagcgtacttctaatccgaaaaatgggtattttttacgc

SEQ ID NO: 7538 - DNA, 464 bp, Bacillus thuringiensis
cgggatcgtcatcatgctgcaaggcttttttttattgcaactggtgaccaagctcttagcatattatcaagtcgcaaagcgttttacagaagcataacacgactttagtcgcgtttcaatcagaaacgggtcgtgcacattatgttcgagtacatatgaatcataatggtgatccactagatggggacggatcatataggaggtctaccagagcatgggatcatcgaagaatggggtgcaacagattatgggaaacaggatctttttgcatgagtggcgataggagatgtggtgcggcacactacaaagctttctaatgacatctatgtcattactcatgaagatgcttattgcattaccactagctggcacactggatatatctagacctgttgctctaaaggaaactaaaccgatctatgatatgcttggtgcaaatttttagatcaaacgttcgtttgcac

SEQ ID NO: 7539 - DNA, 316 bp, Bacillus thuringiensis
accagtctgtactgagaccacaaaccccaccacgggcgggtttattgaaaaagaccttgtaacaaacgcctggacaccaaaccagaaagacactacggaaagccactggcaaaagccacaggggacaagatcagccgaacaagatgtggaagacctactacagcaaaaagaaaacggaggcctacctacagaaacactagaagagcagccgctggatcaaagcgtcagaagaaaccagacacccactgaaagcgacgggaaaggcttacaagccggcaaacaaaccaaacgatcgcagcgaagcaaaagacgttac

SEQ ID NO: 7540 - DNA, 228 bp, Bacillus thuringiensis
aagctggtaacgaatacagaaaacgtaattcccaaaaacaaggaaaaacccagggaggtttaaaaaaaaaggccccccaaaaacccaacaaccgaaaaaaggccccgccacaagaccaagcaccaaaaacagcaccccccggacgagcatcacaaaaagcgacgcccacccgacaagcggcccaacccaacaggactaaaaaaaaaccaggccgaaccccacaggaag

SEQ ID NO: 7541 - DNA, 556 bp, Bacillus thuringiensis
taaactgctttataaacgggatacttacaatttgcgctgacattggcacatctcctctacacgaaattaacttcattgtataatttttcgtttattctaacaataataaaaagccctccaaatttagagggcctttcctaatagcaaaactatattatttcgtaaacattttctctgcttcatccattgccattttgttacctaaagcagaatagtcaagccatggttggtcattgataatatatacatgcttgcctttaacagcttttaagtctttccaaattggtgtttttgaaggttgtttaaatgcagcttttgctttatcatctctatttacaacaacgaaaatcgcatctgatcaaagtcaggtaatcttcttgtgaaatgacttcaagggaacgttttcaattgattttctctacaccatttgcaggttgtaatcctaagtcttggaataaaattggcccatcggtctttttgtactaatacacgtaattcttttgagaacgcgaattgcattctttttcggtttaccagctcttatctataaccttac

SEQ ID NO: 7542 - DNA, 404 bp, Bacillus thuringiensis
cgcggacttttttatcgatgcgtgtatgactgtggcagaagaaggaagcgaaatagccaccatcgctacatccggtggcacagcaaaacaggcaacatagcataacgagatagcaaatacactacctgaagacactgcggtagaaaaagtcgactatcacaaactggcaaataggaaagctggtcatacagcgagaaactgaaatagaggaaagaaatgaagaattagctgactatgacgcaaaatagaagaacgggagaaaacagaacatgccatcagatgtacttccacgtatgatgagacagcctgatatgagagaagatacaaaggaagcactgctccaacagacaggagctatacagaaaaggcacaccagagcaggttaagcagaaatggaacgaata

SEQ ID NO: 7543 - DNA, 262 bp, Bacillus thuringiensis
gcgtaaccctagacgatggaaaaaacactaatttttgcgtcttttaaagcgcattcagctagatctccacgttatcttggaactagtaccgcactatgtgaatgggtaaattcactagcttattgctcagctacacgtgaacgagcaggcatatcacatttttttacatttagccgcgctacagtaggattgactagtaggaacatttgcaaacgcctctgtgaatacagacgctgcaattgttctcgatatactattccca

SEQ ID NO: 7544 - DNA, 111 bp, Bacillus thuringiensis
aattcggattctttctgctacaccatctgttgagtattttttggatgctctattatttgcaataaacttccctcgcttaataaattctcgcctcctccttgctctaataaa

SEQ ID NO: 7545 - DNA, 116 bp, Bacillus thuringiensis
cacaagctgtaggcgaagctttcatcaatatgttctttagctaggctatcttgcatactgaactggatacctttttccggagaatcagtatcaactggctcatacacacctacctt

SEQ ID NO: 7546 - DNA, 133 bp, Bacillus thuringiensis
gttaagcgcgatttttttagcagctccccggtgtgccggtgggagtgtcgatggaacaaagtgcacttaggatcgttcatcagagaacgtgtgaatgaaacctttcgacatgacctcttaaggacggaattgg

SEQ ID NO: 7547 - DNA, 398 bp, Bacillus thuringiensis
ggcgcggaagcttgttgacaatacagacgacggtactaaaccagaaagccacggctaacggcttgcgcataaaacgaggtaacccggaggaggcaagcgccacccggaataaatgggcggaaagcgcgcgcaggaggctaattaagactgatgcgaaagcccacggctcaaccgaggaggggcattggaaactgggagactcgagagcagaagaggaaagcggaaaaccatgcgaagcggcgaaatgcgtagagaaatggaggaacaccagaggcgaaggcgactctcaggacagaaactgacactgaggcgcgaaagcccgcggagcaaacagggatagaaaccccgggagaccacgccagaaacgaagaggggcaaaggtcagaagggaaccgccc

SEQ ID NO: 7548 - DNA, 230 bp, Bacillus thuringiensis
gcattctgcaaatgagaggcacccaaaggagctgctttatgtaggcaataaggtgaagtcataactgtggggaggccactctaagcggatatgtgggctgactgcagacctgaagtttccagcagtttctggatgaactaacactgtgggaatcccctattttagtcagccgcatgcaagctgtgatgactagtgggagcttaccacagatctgaatttctttgacaagc

SEQ ID NO: 7549 - DNA, 149 bp, Bacillus thuringiensis
gaaacacaacacaaggggggatatttaagaagcaccaaccctagagaccaaaaagaaaccccggacagaaccagcccaaactcgaccacaagaaccctccaacacgaaaaaacaccccaaaaaccgcacgcacaacacccaacggcccc

SEQ ID NO: 7550 - DNA, 465 bp, Bacillus thuringiensis
cacagaacaaaccaacacgggggggattaaaaaacaaagcccgttccaaaccacaaaaacaaagaagaagccaaccggcacaaacaaaaaacacaaaaacgaaagaaaaagcgcgaaaaccaaaacaaacacaacaaccccatcatcaaccaacaaaaaaccccaaaacaagacgaaacaacaaaaggcaaacaacaacacaaaaacacacccagaaggaaaacaaaaaccaaaaaaaaccacaaaaaaacaagccgaacaaccacaacgacaaacgaacaaccaaaagacaacacacgaccaaccaaaaaaaccccaaaaaaacccagaaaaaaaaaaaacccaccacatccactacacaggaaaaccccaaaaaacccaaaccccacccccaaaaacaaaaaaaacccaaagaaaaaccaacaccaccagggaccacaaccaaagaaaaaaaccccgaacaaa

SEQ ID NO: 7551 - DNA, 100 bp, Bacillus thuringiensis
ccttacggacaaaaaccgctctcaatggcgaagggcaattgcgagcgccattatcctggtcaaaatttcggtagatgttgggtcaaacagctcttttttt

SEQ ID NO: 7552 - DNA, 282 bp, Bacillus thuringiensis
ggcctctttttagtttgcaccatgcgggggaccgtggggcatagtaagtgggaggggcgctacctcgtgctgaccagcctcataagcggttcatgggtgcacgcgtaatccgagcccaactcctcaagcgatacgctgcgcttgcgtaacgcgtgaagtctcagccgcactaatgggtctgcgctcctgcatgaattgcagcgggcacactgctacgagttacatcactaagccatgggctcccgctgccactacgacaagctgaacgatcggggcgaggac

SEQ ID NO: 7553 - DNA, 362 bp, Bacillus thuringiensis
tctggagctcagttctactttggatttgacaatctattcagagaggcggatgcgtccatactgcgcactttgctgtctatggagcacgctaggcatacattttctattcagaatgtacctgcattcaatggcctgagtatactaagaccaaatatgaccggatgctcacggacggatgcgatacaaactgccttaaaagggacagtgatcccttatacatattagataggctccattgagctgatggtcatattagaatgcctgcttcacttatttggcattggccttcattgatttgtctatagatacagcacaccttctacatctgattccggttacaataagcgcggatcttgctgtgg

SEQ ID NO: 7554 - DNA, 111 bp, Bacillus thuringiensis
actccttttaccatctctttttcttatatgttttacgctagttatacctgaggtgcacatttatttagtgacagaggctgcataagtaggggtattggtatactatacttt

SEQ ID NO: 7555 - DNA, 466 bp, Bacillus thuringiensis
agaacggttttttctatgtttgatttggagacccgcatgacggtgcgaaagggacaattggagatacaactcatgcactgtttatacctaaagacatttaaccattcgttatgaatcgggaataccgccgtgcctatgatggagagggtcatcttgatataaacacactaaatttgtctgttaggcaacttatgagtgaattaaaggacaagattattgaattaaagagtggacgatactgatggagcagtggtgacgataacatgtaccactgatgataaagtacgctttgagacacaggatgctgtgtgcattatggatgcttctacagacgaacgattacgtttattagaacatctctaggccattaaagagctcattggggattagtggtgaagggtattgcccatgaatgttaatctgtattagcgggtggtgaatagtaaatgtcacctgtgagagcact

SEQ ID NO: 7556 - DNA, 253 bp, Bacillus thuringiensis
attcaggaaatttctttttagatagaatccagacacactgaggaaagtcacaactcgtgaagggaccatcgagcgggaatccctgagtccgatctaccaatctgtcttaattagtcttaccgagttgtcaatgcgagaagtcgaaaacaaggtggtaacggactacgtttgtcttttgcataacgactagctgacataatatcacggacctattaatatagagggccaagaaaatgatggaacaattgttacg

SEQ ID NO: 7557 - DNA, 215 bp, Bacillus thuringiensis
tatcggaaccgggttccttttccaacaaggagagatactgtcgagggggtgttcaagcaagtacacgacgacacatgcactctcatgagcgcagaaggactgaataaaccctgtgaccaaaaagcggctgtattgaggaagaatagagcttgtgcgtaatgagaaaagataactgttgccagcgagaaaccactacaacgggcacaactcacaca

SEQ ID NO: 7558 - DNA, 111 bp, Bacillus thuringiensis
ttttatactaatccctccacataccctatgtggtttaaaacttgagaaattatttcctactaacaaggggcctcctcccataccatattaaataacaagcaaggctaaata

SEQ ID NO: 7559 - DNA, 221 bp, Bacillus thuringiensis
gctccgcggaattaaaaattatggtttcccccgggggggggccccccaacatttttttccaaaaaagggggtgtttgtggggggcccccgaaaacccctaaaaaaaaatttccccttaaaaatttggcggcgatattttgggggtgtaaattattggggggggttaaaaaagggggcccccccccccgaaatttttttttccccgggggcaattttttttt

SEQ ID NO: 7560 - DNA, 246 bp, Bacillus thuringiensis
  unsure (1)...(246): unsure at all n locations
ttcgtgatgaaatatgttatttcttttcatttagccgccagaatangggatcgagccattgaataaccctaattgggggggaacaagttggaaacttgatcgcaacgcgtcaatcttaaacaacgacgttttttttatatcaacaaggttgtccatcgaaaccatttcataaatacactgagtaaccatataataaacccactggaacgtaacttttaattccaccagggctattacatcttttac

SEQ ID NO: 7561 - DNA, 190 bp, Bacillus thuringiensis
  unsure (1)...(190): unsure at all n locations
tgacataanntccttggacttctttagccgtttatccagctagaatcatccgacccccatggtcagcggtggtatttaattaggcagccggaaattctggtacaaataatggaaaaactagccccaactggtccctcgttcatttactcgctggtgaagaacgcgaatagcatggaccgtactgctttag

SEQ ID NO: 7562 - DNA, 375 bp, Bacillus thuringiensis
acgcgcttcgcagtcgggtcccgcagaacgcgagattcccttttaatcctgcgctgcattctttttttttggcgaccatcggcaccctgtcggatggcatgaagggatacctggccgcacggtagggcgggaagaaaccataagagaggtggttccttcatatggcatatcactaactgaaaatccgagattgtttcgagaactacgatccaacactgggccgacacgtggttttgacggatataagactgtgccaaaaccctgcagctatattcggtggtgcgctagatacggccgtgttcaccgatagtggctacaggaacgaccgccatcccaattttaaagagcacttggcggggacttcctttcctgtca

SEQ ID NO: 7563 - DNA, 434 bp, Bacillus thuringiensis
ctgtatgcagttagcaggagtaggacgttacaattcgcgttaagccccagttcaccatagagatatttgatcctccatgtctgacatgcgatgctcccctataattcaaaagatactaccgagatcagggtgcgaagtttcaatctcgtataaacacgtactttacttgaaggcctggactagaggttccccaaaccccccgggggggaaaaaagggtttttaagggttttttttttcaaaaacccccccccccaatatttttttccccccaaaaggtgtttttccccaagggtttttaaccccgggggggccaaaattttgggaaaatatttttttgggggggcttttttttaaaatattttaaaaaaaaaaggggtcccccttttttttgggggggaggccccctttgggggggcctttttttttttttggg

SEQ ID NO: 7564 - DNA, 177 bp, Bacillus thuringiensis
tgatcttgaatcatccacaattgctttatatcctcttatttgcatcaggtgctgtgacatcggatgttggcacagctccaacttcggtgaattacatagtaggagcgacatgttgtttactctactactgtccaaccacatagcagtgttttcatttactgtttgtttctttactta

SEQ ID NO: 7565 - DNA, 192 bp, Bacillus thuringiensis
cgtgatcaaaataccacatggggttgttaagacaacgcttttttatccatcaagtgtaacaactaaaggggtggttgattaagggaacacagccatagcctcaacagaagaagaacatggcggcataaaattcactacatgcactcgagctcgaattcttacagaccaagggaccggagcataaacattcat

SEQ ID NO: 7566 - DNA, 118 bp, Bacillus thuringiensis
cagcgaagtatttatgtgttggtacatagctaatatttatcccacttgataatccttaaaggggtgaagttttacgaactaccgggtttagataagctggattatcttttagatctga

SEQ ID NO: 7567 - DNA, 278 bp, Bacillus thuringiensis
acggacccacttcttgttactaaagcctctatagaagattgcaaagtgttactgaccgaccatgctgttacaatctacatggaatgctcacttaactgttggggaaggaaaaatcaggcatgggaacgatgagcccattttacttgtataccgacctgttcaaaaaccaccggttacttgtaccgtggtaacagacaccgtgcgcgctcggactcgcaagatgcaagttgcaacggcacctttaagttggcgaccggcagaatagaacgccattgaag

SEQ ID NO: 7568 - DNA, 323 bp, Bacillus thuringiensis
attattgtttttaataagtggactatagattatgaacaggaacatatctataggaatggcacgggacatcagtccgtttcccaagataaatatgataccctgccttgatgcacatgtacaaacagtctagatttactatacaactgcattgataagcatcacgtgatgctcgtcatggtcatggatggggagccgcttattactgattaccgtgactgccactaaacgtggtactaagctcgaacagggaactactacaagaggcattgatcagacggccttaagtatatacgaatgttgaatgactggctgtccctactgac

SEQ ID NO: 7569 - DNA, 109 bp, Bacillus thuringiensis
cacgccacgtgatttcagaccgtcccctaaaaaagaccggggggcttttggggcataacgggggatataactcacactgagtggtatttgctctctggcctctttccgt

SEQ ID NO: 7570 - DNA, 313 bp, Bacillus thuringiensis
cctaggtcgagagctgcacaatcaataaattttatgatgtcaacggccacatgggactgcgggggcgcactcgaaccatcaggtaagagctacgggtatttgcttaacacaatagctcaccaagaaaaggacgggcaagatgcgtaacaatattgcagaactggaaaagaaaaaattatctgagactagcttcgcaaggagttaaggcaaatcccacagctcagtcgccgatgcagagctcgctcccagctctatttagagcgcctgatcatcaacccacggaactgactacaagcggcgctaaaacatgcac

SEQ ID NO: 7571 - DNA, 367 bp, Bacillus thuringiensis
gaactgttgtactaatgtcatcagattcataaatggagtaggtgaatatggatatgatgctttgtctgctctatagctcgcagaatctctgaaaatggtcgatctccggttgtaaaagttttgagtagtcaatgtgggcagcaccacctccaattttgatgactcccgataatgaacaggacagccattgagcgggactgggcgtaataactctagaggtcttgcttctaatatttcacgatataattctctttgctcttctgaacgacagagatgttctcttattctacagcggctgagaccggacagagcgattaagagcacacctataataggatgaagggctaatactaagaaccatgctaac

SEQ ID NO: 7572 - DNA, 420 bp, Bacillus thuringiensis
ggaacatgatatgtagaacttgttcgggatcgacattaaatttattactgtgccaaaagtttacgcggttgttatggatgcataaaataatggacaggcttgccatgcatctaacgtatcatgggctgactcaacaccatctgatcaatctagcgctcatttgctgaatgatcatataggggaaatgcttactgaggttgtgcacgaaacgagcgtgaagagcagtctcgagaacgaagtacatgttaacgagaatcaaactagcttgaaaacatcatggactgctacaggatcagtctatatatgcatgcctcacacattcgaggtttctaagcatgtccaaagcgaacactgcacgggcggaccacacatgacggctaggtattgaaacatatgacgtaaataattcagaaatttcaa

SEQ ID NO: 7573 - DNA, 226 bp, Bacillus thuringiensis
tttgttagcaactcatttttttacgcatgcatgatttgacatacattgaggggtcacgcattacctggtgtctgtgcccatttcataggggggcctaagagctggtcaggcatggggtacatcggtggcatacactatgacgagtgttttcgcagagttgggtatgtatctccaggaggtgcatgtttaggagccacatctgagaaatgcctagatgtataggggg

SEQ ID NO: 7574 - DNA, 225 bp, Bacillus thuringiensis
  unsure (1)...(225): unsure at all n locations
ccccattaaattctacccacccaagcatacctggggnagagcgcttacgccaacacccccaacagcaccccctaacagcggaaccaatgcacaagccgggaccggaaatacgccatgagcccaaccgccatgtggaaccatcgccacgaccgccgccagagatgccatcccgcatacgcccagaccttggaacgaccacaaatctgctcgcataccaagcaccgc

SEQ ID NO: 7575 - DNA, 385 bp, Bacillus thuringiensis
acaaaacgttcaatttgatgccacgaaaaaggaagaggggcggggaacataaaaagaagcgacgagccaccccggcaaaaatgacatcgcaaccaacaacgccggcccacacgaccccgaacgaaaaaagccagccgaacacgaagaagacgaacggaaagaaacgaaacaggggaacccaacagcggaatgacaaaaaaaaaaacccggacgccccgggccacgagaaaaacagaaccctaggcccgcacaacaaaaatacgggagaccaaaggggcggaacagagcaccggggatggaaaaacacggccaagctttaggacgcagcgaaaaagaagggaccaggaccaacaaacgaaaacagccgcttaacgaagaagcggag

SEQ ID NO: 7576 - DNA, 356 bp, Bacillus thuringiensis
taagaaactttcaatggacaccccgacccgggaagggcgggaggctcaataaaggacagccgggacagataccaactgaagagaaaaaaaacacaccaaaagaaggcgcaaccaaggcggaaaacaggaaagagtcaacgcaaggcgaaccagcggacaaagaaggaaaagccaaggaataaggagagaaagagaaggggcaaaggaagcaaaaggaacaaaaaaccgaaaaagcaaagacaacgaagacaaggaccacatcccaggaacaaaaaggaccaaatagatgggacgaacgaaatagatacgaaaaaaaacccaagagacaaaccagaagggacaaaaaccccaagaac

SEQ ID NO: 7577 - DNA, 227 bp, Bacillus thuringiensis
  unsure (1)...(227): unsure at all n locations
agggaagcgaggcgacgaaaccaaatcaaagacgttacattacgcccacaacaaggcagaagacagggggaaaggtagacgcagcacagcgtacaaagccccctgaaaggagcaagacacggaaaccgaccagcctgcaaaaggcngcaaaagaaacacagaagaacacaagcaaacaacacccccagaaaacagaagccagcccacaccgggacccagccacagga

SEQ ID NO: 7578 - DNA, 263 bp, Bacillus thuringiensis
aaagacgttgatatgtaacacccgcccccataccgggcagggaagtttagcactccagcgccgacggcacacgggaccttgtccctgagagagtaggacgctgccaggcaatataatcccgcagaagctcaacggcagagcaatcggctgctaaccgaacggccgaaggttcgaatcctacctgcggagccattggagagccgtccgagaaggccgaaggagcacgactggaaaaccggaatacgacacaagccgaatcaagg

SEQ ID NO: 7579 - DNA, 165 bp, Bacillus thuringiensis
ggaaaacaaagacgtacccccacaggcagcaaacgatgatgagaaacatactgaaaagaaggaaaacaaaaagaacaaaacgaacgcaacaaagacacgaatacaaaagtgggctgaaatgaaaacaacaccaccccaggagggaaaaccacgagcaagaacagc

SEQ ID NO: 7580 - DNA, 297 bp, Bacillus thuringiensis
gtatttagacatacctttttctacaccggatgacattctctaactcaaggaggacatatttaaggaattgcctacggttaaaaaaaaacacttacaatcggaccatcctacataggttccataagatccgttcacactgttccatgctttgggaagctatttacagctgcactaagatgctggattagccaacgccgattctactgaaagcggtggagtaattccatttacgaaagaagctaatcttttcagttgagactgctatgtgtgtgcacgatatgaggctaccaaacatag

SEQ ID NO: 7581 - DNA, 222 bp, Bacillus thuringiensis
caggttttaacgcctatctctcaacaacctaaagcaaaggccatatgggggagtcatggttaacgcatcaggtcggggctcaaacaagtaccaggatcgccaaactaaacataggcatggatcgcaacatttgttctacaccacattgttgcccgggctaagatctacagacaatcttgcaacttatgacgtcgacagaagactgtatcttccgcgaaaatt

SEQ ID NO: 7582 - DNA, 246 bp, Bacillus thuringiensis
ccacaattcgatcaccagtatatccttctaaagtaggagtgacttgtgattattattaaataacaggggttgccatccgctcattaagtcaacttcatacatacaatcatctcgaaacttcgttttcagtttgaatataagtgactaaattgtttatccatacaaaaaaatgtcgcgttgagccaaactatatcaaagatttcaaatatttctctgaacgcataaaacgaggacactaactatgaa

SEQ ID NO: 7583 - DNA, 143 bp, Bacillus thuringiensis
acgattaccgataggacccgaattcgtgattaacgggcagcccgattagcgagttctaatatttagcggggaatgaacaaaaggcccactggtaaaattttcactttatccctttattgcatcataaaaaaacttgttcatat

SEQ ID NO: 7584 - DNA, 361 bp, Bacillus thuringiensis
aaaaccctcccccacacccaaaacaacaaacacagggacccctaacaaaacaagggtccaacaaccccaaacccccaaaacaacacccacaattataactacgcacccaccaccaccaacaaccgcccacacaaaaccataaaaaacccacaccacaaaacccacaatacaaactaacatcaacgcaccaccaaaaacaacaaccaactccagcaccaaaaggccaacaaacccacaaaccaacctcgaaaaacaaacaacccaaacaacaaaaaacccaacaaaaccaccaacccctaacccaaagccccaaaacacaacaacaccaaacgaacaaaccaacacggacacaaaaccacca

SEQ ID NO: 7585 - DNA, 393 bp, Bacillus thuringiensis
  unsure (1)...(393): unsure at all n locations
ctgctcccctcctccgggcataanccgagaggaaggggggacttttacgccaacggcggagaaaatcgcttctccgtccttttcttataagatgttaacaactggtctaatatctaaggaaggcccctcatcaaatgttaaggacgcaattaattgtacaagagaagttgtttcaaaattggcatgatatgacagcaggaataacaggcagctgctccaatattagttgctacatacattcatatcgagcaaaaccaaatagatacattgaaattctcacttgaccataacatcctccctcagattgacagtcaagatggaaactagaacacttgatactgtccttattatggatagctggctacaatagacgaactctcaaacaatctatac

SEQ ID NO: 7586 - DNA, 276 bp, Bacillus thuringiensis
aaggggaagcgtgacacctctgttacttttttgctctatggcctcttcaatgacctctgtacgatcgtacagagaaactaccctggcttgatcttaccactccttatggatgcgaccgtggtgagagtcactaatagctgcatacgttgcgtgattgactatggcttcgtgagagcgatataattgtactacacacgcaacattatgtgataccgaaacgcacagcatcctggtaagtagaggactcattcattctgttgcacaatggaccttcgc

SEQ ID NO: 7587 - DNA, 101 bp, Bacillus thuringiensis
attcgtgattttgctgaaataaatcgtctaagtgcagcacccctccttcgtttaaatcgaatgcataacaggtggcacgtagaaagaccgcgcgctccacc

SEQ ID NO: 7588 - DNA, 314 bp, Bacillus thuringiensis
tgccccttaacaggctcaacttctatagcatttaattgtaccggtacttctacccctgatcaaaggggttttgtcaaccatgttactggtatctacacatctatcgatgatcccaacgcacctattgttttaagagacgccacttcaaacacagtgtacactacgatttatacagttgacaatcatatattaaaacaagatgataaatgctttagtcgctgtggagacacacttacttatactgtcgattaagcaaagcatggaaacgaaatcgtacaacttgctgtacatactgccaccgtaccaagactcac

SEQ ID NO: 7589 - DNA, 400 bp, Bacillus thuringiensis
aattcgtgtcagcatattctgcacacatgaagcttactgtttatgagccgacttcacaagctggggacggggaaatttcataacggtgtacatccaactggtctgtggaccattccatatggcggcccatcgttcttatgaaagaaagcgcactcagtagaggcgcacattcatattccgactagcccaatttcaaggaaggcagaggcaactgccaataagaaaagtagcactaaactatgcaaggaagatgtgcgattgttgacggacggtactctgaacagacgatatttaaaacgtacaaggtgtattgagtgcacccataaatacggcacctacgaaaagttgcccgccccgagtgactcgggcgcctcttttaaaccgatgcgcggatgcccct

SEQ ID NO: 7590 - DNA, 166 bp, Bacillus thuringiensis
cttgatgctggccttatatgcgggagcgaatgtcctcaactcccttaaccacttattaaccagagatgatggggaaacgacccaaatggggaggtctccttcctcgaaaccctagcacaacagaatctctacaagccctggcttggaaccgctcttcccaggcccc

SEQ ID NO: 7591 - DNA, 152 bp, Bacillus thuringiensis
ggaaaagaagcccgtcgacgaaaacacacacacttcctaaaacgacgaacaacaccacaggaagggtacggaaaagtaacgccggacgctcccgcacaccacggcaacaaacacgatcgagacaccccaggccacgcatcacaccacaacac

SEQ ID NO: 7592 - DNA, 237 bp, Bacillus thuringiensis
tgagaaaatttgctctctgctcaaccacttttaatgcgcgtgggcatactatcaggcctcgacacaagtcctccactgattatacaactacggtttaccacttttcataaacgagaaagcccgtggcatcttctctcggatctacagtatcaactcagcttaatagcgtaactatacgtttaaaatgataacaaaaaggttgcctacgccatctgtcagtgcaccctaatctccctc

SEQ ID NO: 7593 - DNA, 268 bp, Bacillus thuringiensis
cgaagaacttcttctcattccagacgaagtttcgacagggtgggcttgcgatcaggcgagggcgcagcacagcctgtgctactacggtgaacgcgtatcgccacaagggatcccctaggccgtcggaggacaagcgccgatggacagatgaacgggcgctgaaacttaaggagaaacatggccaaaacagaagagagtggaaatttgcctcgcggatgaagccactggaagctaccaaggcgcaatggctcaagtggaatacgcttgg

SEQ ID NO: 7594 - DNA, 356 bp, Bacillus thuringiensis
ggaattaattacgctaacaccaatccagggttcttttgagcaatcaagctaaaattccacatggagcgcttgataccagctagatcctcatataaaccatcgcgcttcccgaacgaccgaggaactcacactcattgcttggcgcaccagagtgactcgtcatctgaatcggcttaataatctatagaggttgacagtaacaattgctagagtatcctcttagaccacaaggcaggagaccctctataaacaggaagcttcacgaccaaattgagatgctccattgcaagggaactccatatttgtgtactgcaatgtacccttttccacttctttctcatttcgaggagaaaccg

SEQ ID NO: 7595 - DNA, 135 bp, Bacillus thuringiensis
atgaagctacacctgcacactcggcagctacgcaaaacactgagcctgcccgacccgctaatgactaaggatcttaaggtgcaaccttgcatcgcacaggccagcagataccaatgggacagtaaacgcgacacc

SEQ ID NO: 7596 - DNA, 121 bp, Bacillus thuringiensis
gatcgatactactggacaagtagaaccagatcatatgtgggcaacgttatcagcttcactgcaaagtaaagatacgactgacattattcctaacttcaaagatattccatacagatggcca

SEQ ID NO: 7597 - DNA, 181 bp, Bacillus thuringiensis
cattaacggttacaaaacgtttcgctcaatttggaaagggatgttataaactacaatgggaattaatcactcctcctgacggaatttaagcatctcaataactggcgatgaggcgataaatcagctccgggaaccatctttgatagttcagataatatttccacgtgtatttggacgaacc

SEQ ID NO: 7598 - DNA, 114 bp, Bacillus thuringiensis
  unsure (1)...(114): unsure at all n locations
cgcttgaatagatttataaccatcaacttcccttgaacctagngacgcaaanggcggctgagggccttttccgatgaaactcccgaacgctccaccaaacaccgttgatggaat

SEQ ID NO: 7599 - DNA, 113 bp, Bacillus thuringiensis
aattccatatgatggttttaaaaaagctacatcaaaagccgccatgtgatctaattgaagaggtgtttaccaggcttatctcccagttccacggatcataaactcttgaggta

SEQ ID NO: 7600 - DNA, 194 bp, Bacillus thuringiensis
ttcggtgattcaaaaagccccacccttttactttttaaaacgacagaaaaatccgggccgggtgaaacccaagggctgtgtcaaccctagttcaaactacctgcaatctgcaggtagatcacttgaagcgcttgggcccctggtgtagggtttcctaaaacttgttccacaaacggaccagggtgggccatgcg

SEQ ID NO: 7601 - DNA, 268 bp, Bacillus thuringiensis
cgattcactttgctccttttcagactaattaacgcgagcgtgtggttactaacaagcgtggtcgcgacatagcccgatcacctggcttcaacatacatggccagaggggatgcctgggtcgacaggatgagaaacgccaacttacagcatacacgccgccgaaagatcgtgtaaaatggaggcaacagagatgattggaaaagcagtacaccgagcgatccaatcgatccaatagagaggtcttaggtcgagtagattacagttgata

SEQ ID NO: 7602 - DNA, 196 bp, Bacillus thuringiensis
gccaggctcagaagcttgtgacaattagaaacattccctctcgtatgtaatgccgctctaacaggggggggctatgtaatgctgctcgagatggctcattcgacaacaacgtactcttctctgcttcttagaaacatatcaatatgcctcctaaagcgcgcaaatgaccccaactcattttggccacattggcagc

SEQ ID NO: 7603 - DNA, 284 bp, Bacillus thuringiensis
ggtaatacattgtttgaaatgtaacatattataatgggtgaaacatattttttgctacaagacacaaatacactactatttgtatttagttggaatatgatttgtgatgaactaatatgtatttgagatatttgggaagagacaacgtatactcgctacgtacaacatatacaaggtgttcaagatgatatatcacagaatacttacacgtttatcaaacattcttatattatcacagtggccgagaatgaaatgtataggcatgcgaatgataccacagtggg

SEQ ID NO: 7604 - DNA, 130 bp, Bacillus thuringiensis
cgaaccagatatagatcgccccagcgagcgcatggcgggggtgttttactaagataccaaagaaattgagcaagccctttaccacgacgcttcattgctgtacaagccgtcgtcctatctgatctgtcct

SEQ ID NO: 7605 - DNA, 418 bp, Bacillus thuringiensis
ccatcatagcatcaatgactgctaactccttttttctatgtactaaacctgcacatgaatggaggggttttttaaaaacatagggagtcttccaacccgtcccttttaacatccgagatgcatgattagacatgcattttttgccaccaatccccccattgaaattaggagcgatttctgaactatagttatctaaaaaaacaacaatccgccccaaaacccttttagaccctcgaataatacttgcaataacatcacctcacgcattttgacctttactactatcgtcgattccttgatcaggtaaaaccattcctttttgccaaccatttcttgctttaattaactgagaaaaagtcccagtaagattccgatcactatccacatcaacccacactctatttaacctttccagaac

SEQ ID NO: 7606 - DNA, 246 bp, Bacillus thuringiensis
gacgcgtacgtactaggatcagagattcgagatggtaagcactattttcgagccagatttggatttcggctagcaatacagtatgactgacacggtgcatcgtgtgaatcacaacaggtaacgcttaaacgacgcaactgtcagggcggctactggtgacctcgccaaggacattcactgcaaaatcaatatccagctcgatttgcaccaagttcaacagttcgtcccataccgttcaccccaagt

SEQ ID NO: 7607 - DNA, 131 bp, Bacillus thuringiensis
ggcgcgaattgctttccttggactgttccctatcttaagggagcggacagaagaaaggaggggatgacttgataggaatggctacgcgttcagaacatgcgcagtaatacaggatcctcttcacaaggtag

SEQ ID NO: 7608 - DNA, 173 bp, Bacillus thuringiensis
ggggcgaatccctttccttggacacgaccgtatcgtaagagggcggaaagctctacgatggggttgatttgcattggaacagtatgcttttgagaacatacgcagtacaactgctgtacttgccaatgttgacagaacgacactaggctaaccactccctctatatacataag

SEQ ID NO: 7609 - DNA, 401 bp, Bacillus thuringiensis
acgcgttacatccaggatccgggatgggggatctagagtaagaaaatccacatgggtttatagatactggaggaaagaaacaaaaacgcccggttaaaattccgagcgtttttgttatcatactaagctctctgggaatatagcttctagctcaggcacaacgaagcgtccgactttacggattagtacgtaaatgaagcaaataacatctccgccgtattcagggaggtggatacatactaaacccaagtgcatgttcgagttgcagccgtgccatagcaacgatggaggcagtccacgcatgaaccggtaagctgccgtccaattatcttcatcaaattggaggcatcccatcggatgacagaagtgtgggtttacgccaattgccaactcaccaacgt

SEQ ID NO: 7610 - DNA, 390 bp, Bacillus thuringiensis
cgaacacggtacatggcctggcgatccacgatgtgagatttcgcatgagataaaaactctacggccaaggcaaaattatcagggattaaccaggacacaggccacactgcagctgtaactacagatctaaccatctatacccgacgatgatgaaaacgatacgtccggtgctatcacaataaagtaccaagcagatacactcctaaaatactcaagagcgtgttacaacataacaccaacaggttatacttcgaaaatataacaaaatttagttacatgtcaaggccaactcatttactgaagagcaggaaatatcatttattcaacaggacacacagcgcttgagcattcccttactatgggctcacagcggccccacaaaataaaaac

SEQ ID NO: 7611 - DNA, 265 bp, Bacillus thuringiensis
cacaattcggtactacttaaagccactgcctctgtatggggaatatagaggatgaagtccggcgacacgcgcgggagatgcaggaatctgcatgccactcataatgaaatatgtaagaacagacggttcaatcgatatgacaacacaccatgttatgtaattgacattaccgcagagcattattgaaccttccgaactttctgttatatggtactagcagtccaaccaagcagaatggaaaaggcatgtacaagcagtggatgag

SEQ ID NO: 7612 - DNA, 439 bp, Bacillus thuringiensis
aggtcgtagcccattcccttcgaacgaccgttggtatgggggcgcaattgtaaaaggagcgctggacttgatgagaagaggttctctactaaagcatatcacagtgtcaccccaccgactacctagcatgtgatgagctccaaagaccagagcaccagctctagagaacggacccgacactgtatacagcaccaacagccaggtaacgaactaaagacccagtgcaatcacagtcgacgtataagaaaccaacaagaaagacttaacctgctgaccagaacccatcacggaagaaaggagaagcacataccaggaaactcaataaagaaattgcaaccattggaagtaccatagcactgtaacctaattgacactaacgtgagaccgactcaagatttctagaaaataccgcgtgccggttatacaacgatatgatact

SEQ ID NO: 7613 - DNA, 315 bp, Bacillus thuringiensis
gggtacacgcttaaccggccagctcggctgttttcattcaatgaattcctttacccatagggccggttgcacatgctggggacatactaccactttatacagggagaccactggcaaggaccacgtgatataccactctcaaggtatattctcagtaacccaagccgcatatgagaacaggggacaatatatgcctgctaaattgcatacgcgggaacaggggacgcctctacgtaatggcatcaattatctacggtcagtaattcaaaccctttccagcgccttgtgatcaaaaacgatacgcgagttggccag

SEQ ID NO: 7614 - DNA, 142 bp, Bacillus thuringiensis
ttctgcttctggaaatgaaggcgacactcttttttttataagcctgcgaatagaccctacagcacctttatcagagtagaagaacttaacccaatacactcgttctttcttctatgaggacctttcccttcactttgcatcg

SEQ ID NO: 7615 - DNA, 164 bp, Bacillus thuringiensis
cgaattcacaccttgttagatgagctgacgatttttcggcgagacaagctaatatgtacagtatcactcgaatgacatctggtaaaggattatcggtgatgacatgatctgcgagcaatacgtcgtcaagattgaagagatactctacggagagctacgtatta

SEQ ID NO: 7616 - DNA, 139 bp, Bacillus thuringiensis
ccggcgaactcagatagaaacacctccttttaaaggtgaaaaatgacagtcgtggacgttttgctttaacatctcgacacaaatactatactaggagatacgcgaatgccgtccatagggcattagccggcgactgaag

SEQ ID NO: 7617 - DNA, 234 bp, Bacillus thuringiensis
taaagaagctagtcttttaatatacagaccccatatcatgaaacctaagcatgaacaatgaaaggggtcctattaaataaatacgcgggtcacccctccacaaagtatttaagtattcactccaagagtcttattattatacaacatagtactctacagcacttttacaaactggctctaacgtaagtcataatataattggaatccgttactacaaacttgtgcacaaccacc

SEQ ID NO: 7618 - DNA, 370 bp, Bacillus thuringiensis
ggtacaccttggcctttctttatatacccaagtttgttttggcgcggaactgggtgacagggggacgtttaacggcttgatgggttttcagcaccgcttacctttccacctggctcccattctcgaatttgcatgggtctacgaactgctttgaccacaacaatgtcttcttcttcgagttgcttgcggagctcgagcgatagtcgcgtaacaataagcgaagctggcactcggctatacccaactggtgcaaacatatattattgatttgcaaagttaaattactccgcgacgcgatttaagaaatcaggcgcaagtagttaatatcatctgatcctgtagaccacgtactttcttttcaacaggttca

SEQ ID NO: 7619 - DNA, 296 bp, Bacillus thuringiensis
cgtaatgtgtattattatttggtcccatcagagcaagcgagaacagactatcaaggggatgagcttgcaagactgtccaactagaaggcacaactatgggattattggcaaggcgactatacagctggtattgggactggtatgagtagagatgacgaattaagagaaaggaagctggagattcctgaccagattaatggaatagcgcacagagctgtccacacacactatgcggcggggcttggcttggtatacttacagtagtatgtgagggtaccagtcccgatcaaagatgt

SEQ ID NO: 7620 - DNA, 355 bp, Bacillus thuringiensis
tttttgtaagtactcatctgttccagaatgggttaccctaaatgcatcttgagtacactcttcgaacggcgtatgtgtatcattaatatggcaccaatcatctgcagtaccattcaataaaagatgacgacaactattgtgtaatacgaagttattatataatagttatcctgcacattcgggtggtttattaactcagctgtgatagtgctctttgataaacacgaaatgtgttcactatattcttttcgaacttagcagctaggcggtagaggaactgaaacattacctccaagtataaaggtaatccccgtattatattcagagccttcatcttaaacataatttggctcaa

SEQ ID NO: 7621 - DNA, 339 bp, Bacillus thuringiensis
gattgcttataaaatggaatatatatatacatctaacgggtggtgtacacttcaagccgtggcataatttactataagtgcatgtactgataactccttaattaaacaatacacatctaaaggaccacagtaaaacaatcatacatcgaatgaaagacaaatcggtcaccaagcattgagtttgacactgcattgttcccatcgaaactgagacaacagatgcaatccgagcgtttcaagctttagaacagctgatgattttcattatgaaagaggtgcgggacaaaaaaggagtatacgctaaaacatacggcctatgttctcttattatctttaaaa

SEQ ID NO: 7622 - DNA, 324 bp, Bacillus thuringiensis
atgaaacgaataatgcagtcttttcttcagtcttctattggcattaatgctgatctcaagtggatgtgctggaaaagaacaacaatcagagacacagacagggaatcaagctgcatcggtagaaacaagtagagataatatctcagatgaaacggaaggaccacctaaaaatggtcatacgattgaaagacatgtaggcaagtcagacgaggatttgaagaatcgcttgacagacagataaagtggccgatcgcaggttcatactatgataaggaaacagcgcccacagctgcaagagacagcttgccgcaacatgacatggaa

SEQ ID NO: 7623 - DNA, 206 bp, Bacillus thuringiensis
tcaaatgcagatggttattatctattatgcgtgcgcactgcaagcgagttatcacatgtacgacatttattgtaacacataatgatatcttttttgctgggaagggatggtctagatcctccttgtactgctagccgtgtagatttattacatgctctttcacctgacgctagctatgatcctgctactacattaaacgtcggcac

SEQ ID NO: 7624 - DNA, 176 bp, Bacillus thuringiensis
ctgaacatcgctgtaaccacgcatgagacatatgattaaggtagcctgttgaataatctataaggctttgctggacatgaaccgtaggagagactagacaatgaatagattcagcctaattttataacatgatatagaatacgtgatatcctaaacatccagaatgttctgctaaa

SEQ ID NO: 7625 - DNA, 113 bp, Bacillus thuringiensis
tgggtttacgcgtgtactttgttcagccacttttttaagcacaaaccttggcttatgtaacgggctacctgaacgcgctttacgtggcgtcccttgattatgcactctaggtg

SEQ ID NO: 7626 - DNA, 143 bp, Bacillus thuringiensis
  unsure (1)...(143): unsure at all n locations
atcatagggggttttttaaaaacactggggattactaccacatacagccttcctaatccaatatcaaacgatgaggtccaccgatacatggnntngtganaatcttcaacttaaagggtgtataaaccaaaattgtaatcttc

SEQ ID NO: 7627 - DNA, 110 bp, Bacillus thuringiensis
cgaaaaataatgaatagccatttcaataatccaatctcgggatcgggtggcgacccagttcggaacgaaattcctgaggagcggtacgtgggctcaagacttacccgtat

SEQ ID NO: 7628 - DNA, 159 bp, Bacillus thuringiensis
tccgcggcttgatatccgctatgtgcacaagctaggcggatgatcgtgcttcagcgagacggttgaaacagcattcactatcctcgactgaccagcgaaagtctcacttaacgtactctatgaatccaagctagaggcgcttgtcgagacaggagataa

SEQ ID NO: 7629 - DNA, 397 bp, Bacillus thuringiensis
gcgcatacgggctttccgcctgcggagcgtactctgcttgtcctagtgatccactgctgagtgactttgagacacaatctgccccttttgactatttaaacactcgctgaccataccctctcattgcaggctcgcacggcttcgctagaaaagaaactagctgcctacgcgccaacagggctgctgaggtcgactcaggtactgaaattcacgggctagcacgtgtatagaatcgatagagcgcactggcaagagtgcaggtggatttccgacgccctatccttgtaacagctaatcacagcttggctaccacggcggggagcatacgtggtcagacggccatgtgggacgcttaactgagccagtgtaccacgtaacacccgctgtctgaacgcat

SEQ ID NO: 7630 - DNA, 383 bp, Bacillus thuringiensis
ggggtctcaggctcgtagttatcatcagctattttagtatccctgctgtcacccggatcgtagaggcctgcttaccctatacagatcctgctggcttgcgcatctggatacatcgtgcggaggtgggctccaagcatcgacgcactcagaggtaatccctctggaccgtaaagacccaactgactctgcggaagaacaactggcacactcaccactgagggcacaccgatccgtttgtagtagggacagaaagcattgaaaagagctacgcccactaccgatcagggaccaagctgtctaacgactcatggcccccagctcgggaaccgggtgcatgggcgttctggcaagccccggggaccgccgacagcgccaggatgcaa

SEQ ID NO: 7631 - DNA, 221 bp, Bacillus thuringiensis
cgcttacgttcttgtacctcggcctgccattttcgatggggttgtttaacacaagcaaggtgagcacccggccactaatcatactcttgctcacgagcctgctaccatggtagactccaggaatcacctggcccttgagtgttttcatccgcctcatatattgatcgctctctgttgcgtcagctctcatctggctaccaactatatgaggcggctgttgt

SEQ ID NO: 7632 - DNA, 137 bp, Bacillus thuringiensis
acaacactctaagctagtaataaccccgcctttttactctccactgcagatacaatttcaggtgtgtatattaaacaccgagggtgttcaagcatcccttcgaaaacgatcaaaccaattaagccccatcttcttac

SEQ ID NO: 7633 - DNA, 169 bp, Bacillus thuringiensis
acgctataaacatccatgtgtgagcatacttcatggtagaatatgcagtattatactcgtatataatggctcttaaacacacaatactcgtctcacttttgcaactactaagaagggaacgcgatcatctaggcgttctgcataacgcacaataaagattaatgcttgg

SEQ ID NO: 7634 - DNA, 146 bp, Bacillus thuringiensis
cacacgcctcctaagacgaagttagacacgcgaatacgagggatcgtgatatcgcaacacatgccatgaagcaatccactgcgaaactgacatccgtaagtcatgatcttgaatcccgtttatgttcgctgcggaaattggacctt

SEQ ID NO: 7635 - DNA, 213 bp, Bacillus thuringiensis
cgatcaattcgatcctagagatctagctaagtccgagggccccaagggggcttttaaacgccattccggttttcccccacccgctgtattgtctaggcattaaaaaagcaatgcatatgtaaaattgaaacctaatattgatatcactttccatcttcccgacgtcttgcaataatcaacgttagaagctattaggggccttacttcctatgg

SEQ ID NO: 7636 - DNA, 146 bp, Bacillus thuringiensis
taacctatattcacaaacttcttaaaacaacaaaagggggaaccaccaggggccatactaaggatactacccgaactcacagacacacacggagcaaacaactatcacccactcccaaccgctatctatacagcagaaggtgcttt

SEQ ID NO: 7637 - DNA, 199 bp, Bacillus thuringiensis
aattcggatattccgtttgcgtatgcgctaggaaactagctatttaacagttacgcacagattattcatcgtgaaccatttacgatataggacttgattacacgtcacattgctacgagctgaaagagcttattacaattgtgtcgggcatgaatattaatggaatgacgattgtaggagatgtgaccgggcgaaatat

SEQ ID NO: 7638 - DNA, 252 bp, Bacillus thuringiensis
gatggacaaatagcttgagcaagcatataatttggtggtattggtggaagaacaaacacaaaatcgttggtttaaaaatgcaatcactggtggggaaaacacatctactcggaaggctactgggcctaacttaacgagtaagtgtcattattgtgtaacttaaaaaggatggtatctaaatgaagcgctatctcgagctgattttgcaccaattggaactgttcaacatgatggttatgcatcttcaaataa

SEQ ID NO: 7639 - DNA, 221 bp, Bacillus thuringiensis
catcatctgaaaacgaaggtgggggcgaaaacttctaaggctcttaccgctggctgcgagcgagtgcgatgtaacaacactagcgcgccgaactgccggaaggcagatttctactgagtcccgcctgtccggtggagcaaggtcagggaggggggatgccgcaataacaggcaacgagctcccaacccagcagccggatcccacgactgtcacatctctaa

SEQ ID NO: 7640 - DNA, 397 bp, Bacillus thuringiensis
tcaatatgcaccacatttatcgtatgacacaccgttctaacgtactgaagaactacctctcgatgggcaagatggacaatcgacacctttacatgaccatgacagtacatgtggagtagagcgctgtttttaacgaaggactatggcgcatatctacatacagactgaacagcttgaaaatagactagattatataacacattcaggaaatcttaatatgcgagaaggatatacagttaaagtattttcaccagcggattgtcatattgttgtaactggcaaaagagcaagcgtacctacgattcatgtctatggaaaacggttagaacaagctaaagtacctttaccaactgaagaaaaaaacgtgttcttgtgtgagacagaatacattggttat

SEQ ID NO: 7641 - DNA, 157 bp, Bacillus thuringiensis
acacgctttgcgtcgcatcccgcagaacgcgagctggcacatcgccttggttattgatatgatgaaagtataaaagaccgggctctagagaatgaagagaacataaattccctgtattgataaagtaaactcgctatgggtgccttatcatcatagg

SEQ ID NO: 7642 - DNA, 241 bp, Bacillus thuringiensis
attttcttactccctactatcagtaattggctggcgactggtgcacattattctgagactagctcttacgataagaagattaaagcattacaaaagaaagaagtcgaacgtagggaaaaagaagcagccgaatataataaacaagctcaaacttctgcgaaaacatttacagacccattctctgaaaaaaaacgcacccatcaagcgcatgctgacgcgttaaacctaggagatgccatgg

SEQ ID NO: 7643 - DNA, 295 bp, Bacillus thuringiensis
attgaccgtcccattcgcttttacttgccctctagtgaagcttctcactcacgctcacccagtgaagctgaccagtacttaacgcactaactacagtaagagacgactcatcacctcgcgctaataacttcataccactatgaagtgatgtagtttcttgtctcaaatcatttgctccccccggtaagggagaatgcatagactcaagcttgtgactccccacttccaattccgatgtactagggccagaaccatcaacaccacttgcaagctgatccgctccattccttgcatc

SEQ ID NO: 7644 - DNA, 271 bp, Bacillus thuringiensis
cctcgaaattacatccgttcacgaactactatcacttgaacattttaaaccccttgggggtactaaccaaacttgacccttagtctcgcaacaatttgctaagcttaaatctccctatatccaactgctgcaaacacaaccttcttcattcgcaaagtcaaaatctctccccgaccccctcctaagctatcatgccctaataccttctctcatctaatacactagaccacatacttacccctacaacaagaaacacggtccttccacccaa

SEQ ID NO: 7645 - DNA, 200 bp, Bacillus thuringiensis
actgatcatgcttcgttgcaacctccggacgcggcacagggggaggggatattgcgacatcaaaggcgtcaatcaccactttccacggaccaaaccactatgcatgctcttggtgatatgcaagtacctcagtatacgcctgtcaaaacgccataagtctccggataaggtctgaatcctgtaaccggaacgccccacgc

SEQ ID NO: 7646 - DNA, 117 bp, Bacillus thuringiensis
ctctgctgattcctctttcgaaatgacgcagcgacgatgggtgggttgaaccgccgcaatcacctaaatttccaagcggctcatctggatccggttgggatgcacagggatcaaagc

SEQ ID NO: 7647 - DNA, 222 bp, Bacillus thuringiensis
ttcgtgattttatataaaaactgtgcatattgatcatttttttcgaaattatctcctcaaaacttggctgggcttatataaactttagaggggggtattataccactataagctttcacatcatccttctcgcccaactggtcatttcggtactattctttaacaatctctcctgcacatatttatctatttttctttgtaacatagacaatacatccttat

SEQ ID NO: 7648 - DNA, 179 bp, Bacillus thuringiensis
ctagactctagacgcctgatttcgaatacaaaagtttacttttataaggcaaaacacgcgactggacacaggttggatggatctgtgatgcgcaagacagaccgtaaggagcactagccgggaacaaaaaccttaaaaaaaacaaccgggactatagaaacatattagcataaaacaag

SEQ ID NO: 7649 - DNA, 110 bp, Bacillus thuringiensis
cgttctaaggacagtgaagtcagaccgcaaggtttgctggcgtgctcacaagtgagaacgcgggtatgagtagcgaaagacgggcgataatctccgttcaccgaatgcct

SEQ ID NO: 7650 - DNA, 117 bp, Bacillus thuringiensis
gagaagctgcgacaattcagacacccccattaccacccaccaaaaacgccactgggggatttaaacccagggccggccacaccccacccacacccacttacttctcacgacacaacc

SEQ ID NO: 7651 - DNA, 159 bp, Bacillus thuringiensis
gcggatacatactggcatgcatttagaaacacacacaagaagattttaaaccctggggcgctttcaccccccccccctctatcgacatcacccacacccacgccccgcccgccccccttagagcttggcgtaaccatggccacagctgctccccccccc

SEQ ID NO: 7652 - DNA, 109 bp, Bacillus thuringiensis
  unsure (1)...(109): unsure at all n locations
cccagaacgcaatttgctactagccgagagacaacgcgccgagagggggaccggggcaaaanacaccaccgaagccgcggaccgacaccaacggaacaagcggcagggg

SEQ ID NO: 7653 - DNA, 219 bp, Bacillus thuringiensis
gtgatacgacattacaaacttatattcactcactcttgttggagcccgcctcaaaaatacttcacttcccgttcaaatttaacacaattggcgtttgcacacctatctcacaatccaattgaagaaataacaccactatcttcatcgccaaacttacagcgatcaaatcttgcggacaatcatattaaccatgtaccgcctattggtttcatgcaaaac

SEQ ID NO: 7654 - DNA, 298 bp, Bacillus thuringiensis
gaacatacctagtacgatggactgaatacaacttacttggtggttaatcattgtctacatcggttcacgcagatattacagcacccactactgtttatatgatggctaccgatcccggaatgatcgtagtgaaaaaacattccattacgtagatggatatccaacaatgtaagaagagagatgcacgttgcataccattaaatacacgctacattagaaaggagcaccgtattataagaactgtcctacaaatgagaaaactaagaccgaaaagccccagaatagaacctgcatattt

SEQ ID NO: 7655 - DNA, 306 bp, Bacillus thuringiensis
cctattgacatacaaaatttagagcacgctttttttttggtttttggaactaatcctcttgatggcgtctggctaaaacatgagggctacactacttaacggtaaatttcacggggtcaaatacatatcatagacgccatgtgcttcattgcgatgggccctacgatcgtgctcgttggcgagtgcaccgatattctagaccctgcacttgttaggagaggtcttgagagtaactgccagaactagatgatgatgggaagacgatggacatagtgtctcatgaacttgaatctagcacgagatgta

SEQ ID NO: 7656 - DNA, 427 bp, Bacillus thuringiensis
tgcatgatcatcaccaaattgatatgctacatctcaagaaaactgttcatttgtttcttgcagggtaccctttcccactcatttctcatattgagtagaaacggtcactgttacctctggttattccttcggaggaaccacacacactttgatagaatgtactgactcactacgtagcactcactcatgctgagttggggactccaccttctactatatgacgcgctatattatgattgatcgacgcgatacagattgctagcagccaagagcaccgtatatacctcacctgggaaatacacatagcttacttcttgcttcggcactataatcatcacctgtttgttaggagaatcaactaagggctccataattacgacttgacctttatgtattgtaggccctgacagaaaatatgtctaataca

SEQ ID NO: 7657 - DNA, 251 bp, Bacillus thuringiensis
acacgacatgttatgacgttccggcccaacgctcatgaagtcatcatctcccaagccaagtggggcactgaggtcattaacggacctgcaacgctgtgccaaatgagcaacgagccctatcccactcggtcgtcctgggccagctacttaatctctaaggacgtgtcgcgacacagctagctgcaattgctccggtccattgaagcggggtcagactatgataacaagacctgcgccctcttgagaggtac

SEQ ID NO: 7658 - DNA, 167 bp, Bacillus thuringiensis
atctaatctttggaaagatcctcgagagcttacatgaggaattttggatcctatgcgaggcgcatatgcagcatgcgaggaaccgagctttgcctatagagagtcggattatagctagggggaatcatgggcatagttgaatgctgcatgaaatggatatgcgaata

SEQ ID NO: 7659 - DNA, 102 bp, Bacillus thuringiensis
gagccaaaacaaaaaagggccaaagccaccaccgagaagaaagaaaaaccagaccaagaagcccagggcaaccgccaacacccggacccaaacaccgcaccc

SEQ ID NO: 7660 - DNA, 233 bp, Bacillus thuringiensis
gtaaacagcaagaagaagctcaaaagaaagctttgtggacgctagagggaaagcgcggtagaagctcagaaaaaagctgaggaagaagtgacaaaagaaagctgaagaagcggaacttgcttggagctgaagaagaggctaataaacaacatgaacagcgacaccaaaatcccggcggagcctcgcttcacgcagacggtgatgacgttccgaccatgtactaatatacaaaa

SEQ ID NO: 7661 - DNA, 101 bp, Bacillus thuringiensis
aaaagaaccacaaaaacccccagaaacccctccacaaaaaccagcaccagaacaaggggggagccagaaaaaaaaagggggggaaaccaccaaaccccgcg

SEQ ID NO: 7662 - DNA, 263 bp, Bacillus thuringiensis
tccgatgcattctagacctactgcatcactctttctttacgtgtctaaagagctggcagtctatttctgacgtcgtgtcagccgctttcgaatactctcacgtgtgacttatttgctctatgctaagactccgtgcatatgctgagcaatcggctccagaacctcttgaactggcacgccctttggtggcattacaagcacatgatgatcactatgaaccattactagcgcgactctcattattggtgatacaccctaacatg

SEQ ID NO: 7663 - DNA, 262 bp, Bacillus thuringiensis
  unsure (1)...(262): unsure at all n locations
cttcttacatcccacccctctctttcacatcttttcttctcacttccttgccttccaatatgccatgtctatttcctagtcgttcccctctacccactacnnnnnnnnatcctgtactcgttgcttcattacttggacctccatttcgcctaccagtgattgagtttcctcgttcggacatagttcacataccgatacatgcatacttggtccatgctctctataattacaaacttgttcagaaccaccacacaattgtctt

SEQ ID NO: 7664 - DNA, 217 bp, Bacillus thuringiensis
agaaagaagtttatttaatgaacaaggtcacggcgccggggggggttttttcacttatgggcaggaataagccaatcactgatggtcgccccggttaaatgaattattcccctcacgcacttgttttgaccagctacttagaaatcaacggtccttgttgccgtgctattaccggacatcacgattaatatggcagctatcggcctatgtatactcc

SEQ ID NO: 7665 - DNA, 308 bp, Bacillus thuringiensis
agaaaaacttttcttcacagaaaaaggccacacccctgggggggatttattaactacagggccgttacaagccaaaaacaaatcaacgctcaagttactggcgctaaaccatacactacttcgatcagaccagcatcttaccaatcgaagctccctcgagagcttacaagacccgacatgaccatatagacagcacctgacggcccctgtaaactcataagcggactcgcctcttcctaccctactatttaccaaattcctgtccgtctacgtatcatcagaaagcctggggcacactcacaaaccac

SEQ ID NO: 7666 - DNA, 198 bp, Bacillus thuringiensis
attatcaaacatgtgttttttttcaggaggaatatgaattgttctagggggggttaagaccattatcttgaaggattttgagacgaacaaagtattttatttattacaggaccttttattaaagataaaaatcttaatgtgaaattggactttaaatattaatattccaggaggatatttgatgaaagctatcgttga

SEQ ID NO: 7667 - DNA, 391 bp, Bacillus thuringiensis
gctgcccgttttgatgtgagcgatgaggaagcagatgaggcggcggctcgacctggccaatttgagatatcatcatgtacagcttgatctggtggattaaactcagcccaaaatgtacggacatgtgtcttatggcaagcgataccggaatcatgacgtttattaccaaccattactttatcagtgagagctgataaggcttgatttgcgtcggatgcacgattttcggaagcggattgtgcttaaacgttggattgctagcctgaatgttctgagatgaataaagaagcagggagaaaaagtgcattaatcggattgtgaacaggagttgcgtctagagagaaacaggactcctttggtaagcggagagccatttcataggtgcatgatg

SEQ ID NO: 7668 - DNA, 309 bp, Bacillus thuringiensis
  unsure (1)...(309): unsure at all n locations
tccttactcgatctcctgccgcttcttcctctcccttcaccccaacatttctcttacttttcttccctctttccttttcctcctccttcttttctncggtctacgttcctctacacctatcactgcggacagcttcatgttcaccccttgctcgctcagttcttgagtacgttgaataagccgtacgtgcatgcgtccgaatttttaattaagatctttctaccatattgatacctacacgtcctcccatagtccaatcgcatttcaacatactactattgtggtacacccgcatcatcagctcctctt

SEQ ID NO: 7669 - DNA, 317 bp, Bacillus thuringiensis
  unsure (1)...(317): unsure at all n locations
atgcaccattacccggaatcatgcaacaggccgaatccattcccaaagcctactctccaatagtaacgaaagtttaatagccagttttacttatccaacagctggcgtcaanactggagtaaccgttgtattcttactcgtactacagacggcaggacattggtcgagactcacggattatacatcattgacaagaccattatgaggtaatgtgccactaggcgggatcgcttaccattgtgctcgaacagtaatacattcagtatcccctgtccaactatctgtcttgtgaacacccacagatggagctcatcctg

SEQ ID NO: 7670 - DNA, 181 bp, Bacillus thuringiensis
tactgacatactgagtcgcaccggagggactaagtaaaaactctctgtgtaattgcgcacaccgtaccgagcttagcgatgttgtaagcacgatatgtacataatacttcaccgcggcaaccgaatgcggtctatacataacggactctctacgagcaccacttccatccatgtactcgag

SEQ ID NO: 7671 - DNA, 101 bp, Bacillus thuringiensis
tatccaacaacctttcttggaaatatcccacagcgggacacgagggggggccgaaggaccaaccacggggactattcacagtcggggggagaaaaacccca

SEQ ID NO: 7672 - DNA, 155 bp, Bacillus thuringiensis
tagtactgacggttactggacagaggttgctgaagggccaactgcggggcagaagggggctacacacgcttagagccatgtggctgactgaacgctagtgcacgagctatgacaccgactagatatactgggtaaacgggttatcaagggcaatt

SEQ ID NO: 7673 - DNA, 186 bp, Bacillus thuringiensis
cctgctgcataaacaagcgcaccgccacaatctccttgataaatcgctgcatcggtttgaaccgggttttcttgccaataataaggtccatctggacccaacatcacagggcccattactttaagtacgttgaattaacccctggggaacctgtcccagaaaattgcagccaaggggggtccccaa

SEQ ID NO: 7674 - DNA, 104 bp, Bacillus thuringiensis
caaacccttgtatctaactgtaggacagagcaataacagggggtgcttacgaaaaagtttcaatttatccgggcgaggtaatccgactacttgccaccgctgag

SEQ ID NO: 7675 - DNA, 189 bp, Bacillus thuringiensis
gattattctttacaaacaaatctttcgcacaataataaattcccacacataacatcgcgatcggtggacatattaaaaatatagcgcgcatcataacctatacattcttttatttcaaaactccatccaaataccacttcacctatgtaccaaaccctcattactgaatccaatatttaccacccctca

SEQ ID NO: 7676 - DNA, 196 bp, Bacillus thuringiensis
tgaaattaactaataatagttgtcagtgatattgaaatggtcattttatatcaatctttctctcattttattttctttcttattcgatagactgcttgttacaaagcctttattagtaaggagatttaaataaaatggagaagatattaagaaataaatattttccatgcgtgtgttaaaattataggtattacta

SEQ ID NO: 7677 - DNA, 219 bp, Bacillus thuringiensis
gaattcgagatcgagttacccagccgtgcaacaaccacctttttttggctggaatgaaggcttgactgagacggtagatccaaaggttacagcatccgatactgcaaacagtgtgattgatgatcgacacatgacatgtgatagccctaacggaggcatgccagtttctagcttaacagagtgaagagagcccagcttcctgtaacacaaacgtagcag

SEQ ID NO: 7678 - DNA, 318 bp, Bacillus thuringiensis
cactacttctgtaacaacttcagaaactaatgatagggggatattttataaatctagaggggacacagcctctactgcttgacgtgttggagcaaacagagcagacgatacatgcatttcaggatgtagaaacacaaacatgtgttctttgctaggacctagatgatactcgactcgttacttttgctacagctacaagcccatgtccagaggtacaaatgtctcactgagaagtaataatcaattactggtctgcagtccctgagatagtaattgtcacgactagcaccgatcaaatatggctaacatatagcgggg

SEQ ID NO: 7679 - DNA, 171 bp, Bacillus thuringiensis
ggcaaaacgtctatttcaagaaataggacacccccctggggcgggtttatatgcttaaggggtgtaacaagcataacccagtactgcgcacacggtatctgaatgaatccatgctcgacatttgggagaccagcttgctaacaattgaagctcattcttgagctggcacaa

SEQ ID NO: 7680 - DNA, 271 bp, Bacillus thuringiensis
gtacgctattgtatgttaatggttgccgcgagcgggggggctgttttgaatataaagtccaaagccgagctgatgcacggctttttactttgtctgtctaagcattcaatacttatagggaaaagaggaaggcctcgcccatttatagggaagacatcatgagcgcttctttacatgtttagaatgctgagcaaataatgcttgcgctattcttcggtcgacgagatgtagatgtcacttgtgatagactttggaactggaaaaatcctgg

SEQ ID NO: 7681 - DNA, 160 bp, Bacillus thuringiensis
  unsure (1)...(160): unsure at all n locations
ccgaacactgatanaaaaaagacgggtaaaatgcaaaaggcgcgttattttgtgcgtgagttcgtgcgcacacagaaacgaaaaagcacttaatgcaagcgacaagaagatgtcagattacgcatatgaatcctcgattagcagaactgggaccaattga

SEQ ID NO: 7682 - DNA, 616 bp, Bacillus thuringiensis
tgatgaataatttttgtatttgtgtgatatgaatcataagttggggggatcggtaaacttatggttgtttttgatttggacaaactgttacttttaggttttgaaaaaaatttttaatgtcgttttttaaataaagtcacattgtttacaaaagaggtgtaatggtttaaaaaaattgcgatgtttggttccttggaacctttttatcaaaagggatgtttttatagcgaaaagaagatctgaactaaaaggccgattaaggaaatgttaagtagcaataaagttatttcatttttagaattagctacttttttttgagaaaaagcttcttcactatattatctaaattaatttggttgtattcttcagttcgaacaaactataaaaaacatcatcttttttagttaaattttagaaataaaaacttttttacacttggaggagttaaaaaactttaattgataggaatgtatacggactaccttgtatgtcttttgaggagagcatttgagtttgccattgtccattattatttaaagtgcatattacataaaatccctaaagtttagagaaacattttttgcttaaatttattagattaatgtcccacaaattt

SEQ ID NO: 7683 - DNA, 152 bp, Bacillus thuringiensis
caaaaaacgtttcctcacagaaaaaggccacaccaaaggggggggcaaataaaaaaagcggccgggacaaacaaaacacaaagcaaaggccacgaaacaggcactaaaccacccacgcccacgagagagaccagccagataccaaccgaacc

SEQ ID NO: 7684 - DNA, 116 bp, Bacillus thuringiensis
ctattttactagaaaggtggatctcttattactagttacagtcgataagctttttattagtaataagaatttgccagctagattaatgtattttttaaaagtggttattatgaggt

SEQ ID NO: 7685 - DNA, 303 bp, Bacillus thuringiensis
cacaggcaacttaaattaactcttcagggcgtttttataccgcctcatcataaaaatcggggggcatttgtaaacggccagggcgtaacaatccgttaagcgactatatacgaaagactcgagtccatgatcaatgacattaagatgatcaatctatactaatagttatctaactacctgctcacgctaacgaggatactgcatttctgattgataagccggtctcacccctgaattttcatgcagactgatcattccgctatgaatcgagagcacgttcacatactgagactactcactgct

SEQ ID NO: 7686 - DNA, 197 bp, Bacillus thuringiensis
cacaaaacgtctcttcccagcaacaggacacaacccaggggggggttcatgaaaaaagggggcgggaaaaaccccacacagaacaacacccacggcaccgacaccaaaccagacagcaccaccaacaaaccagccaacaacaaaccgaaccaccacaacaggcacaaaaaaaccaaccacaccacccaaacaccacc

SEQ ID NO: 7687 - DNA, 246 bp, Bacillus thuringiensis
cgcaacagttggtttatcaatagcacctccagaaaacaggagaaagggtaacacttaaagggacaccacttgtactgcttggcgttttagtgctaccagcacagggcaaagatggtcttcatggtgcattaacacagactttggtcctgtcataggccccagttgatggacgacaacgcactatcgattatacgctaaggctcatgccgaatggagggatgtaaaccggagggtttataacgcatt

SEQ ID NO: 7688 - DNA, 309 bp, Bacillus thuringiensis
  unsure (1)...(309): unsure at all n locations
cctgtccttcaatctttctacgcttagtaccctttttcttccgcctggcctcccattttatctgcgccgaatcgctgtattcgacaagctccacctctcactgctannaagttgacaactactagatgagacaataaagctgtcagcaaagtaataatagggggagagagcgcttgcagtcactgcacaaaggtgatgaacttttttctaagaacaaagccgcgcatttccaacaccctatataagcaggtgcagggttctttgatgcacctcatttactgaatgccccattgttctcttaggagatag

SEQ ID NO: 7689 - DNA, 298 bp, Bacillus thuringiensis
ccaacccagcttaaaatcattcttaagcttttttacacaactccttatattaacacccgggggccatttgaaaatccagggcgcctaacaatgtaataaacaacttacttccataaacttgggtcttaaataactgatactacaatgctccatctatgccaacacttactagaccactctattcaactcacgccgtaactgctttctttatcgcccatgcattcacacccactagtatacttgcaaagggctctgtaaattatatttgctatactcgttcacattctaagacttatca

SEQ ID NO: 7690 - DNA, 459 bp, Bacillus thuringiensis
aattctgctttttctacatttataagaaacatatactaaggggggtgaattgaaaaaaaattaccatcttaaataagatgctaaaaaatgctacaaacagaatcacagcatatctttcacatagcaatttcacatttttaaaaattgaaaattcttggatatgtaatacttttccttatttgaatatgaaaattgatacccttgccttttataaatttcattttaaacaattctaatttacaactttcaacgatgaatgtttgccacataaaatttatgcgtagtttcttagatttcgcttaaatgggtaaattcgtatggagcaatacccattttttctttttaattacaaccgtaaacttatttagagtactttcgttataagaagttagtagtacaggtgcaacttttttttttgccctaggtaaatatctaatatacttgggaaacctctgattt

SEQ ID NO: 7691 - DNA, 315 bp, Bacillus thuringiensis
cgtgatattttacttcactcaccaggaccacagcctgtttttctgcccacaagtgcctatttacctcgctccatatgctccctctgtccactgccaccgctatttcctgaccgcctgtatccaagctgaactctggtaaggacacatgaggctgtactttcaggaattccgagattgatgagacctccagcgttgaatgactgggaatggtgatacaccggataatatttgacctggcatcatgcgctgggagcttataacatccagaccgaccatagaatgaaatgatggtaaaagagcacagtcacaagcatg

SEQ ID NO: 7692 - DNA, 169 bp, Bacillus thuringiensis
cggcatctggtatagtccggatgttccccataagacactagctttctatcacttaaaacaccggtggtcttaacacctattcgagttcgttttcttcataatgtcttgtcactgtcgatgttaataaaacaccgggcaaatgagcacatttatgttgaattgcacgcgc

SEQ ID NO: 7693 - DNA, 354 bp, Bacillus thuringiensis
aacagtgatgcgctaggaactatcttagacgcaaccgaaaacatgcttaaaaaaaccgtaatgaggcgtgctgatcgatctctcgaagtgtgaacagttatactgagagtactggcttacgttggcatatgtacaagaggcacccgtaattgtatgggaagaacggtcaggcgagtaccgacgcttaccatatgctgaaggaggggcaaatgtggaaccgtgtagtgattacttcgagggcagacggtcctgtattatggtgccttcgatataagcggctgagggagctatttcacttacagctcactgtgatgtagttcgagagggcttacctgtggcgggggagatgcagat

SEQ ID NO: 7694 - DNA, 354 bp, Bacillus thuringiensis
accgtactggtgaggtagaacatggagccttctgttgcgacttttattggcttagcagcggtgctagcgttagtgcctactaacgtggcatatgttttagctcaaggtggtcagtacgctatagaggatgcgacaagcttgttcactggtgcttttgggctagacgttgcggatagctcaaacaaagcatataaatactatgagcaaccctgcttgatgacataagggtactggcaacctcttcgacatgcgctttaagtgttagaatgcaaaggtgtcgggatggatttaactacaggtattacgatggctgcgactgaaactaacatatgtctgggtcgggattctgaaggg

SEQ ID NO: 7695 - DNA, 113 bp, Bacillus thuringiensis
aaaaattgctcgaccccaagaacgagcacactagggggggataaaataagaaaacgggccgcaaaaaacacagaaaaacaagaaagcacgcaagaaaaaagaagaaccccacc

SEQ ID NO: 7696 - DNA, 197 bp, Bacillus thuringiensis
caaaacaggtttgtttaatgaactaggtcacgcccatgggaggggtttagttcacttcccgttgtgaaacccgaaaacctgttcagcactcaggataaatgaattacaccacccacgcccagagagagacagctagctaaccgctcgctcgcacgctcgatcacagacagacaaacctcactcgatagacagcgtct

SEQ ID NO: 7697 - DNA, 308 bp, Bacillus thuringiensis
ctacgtcctttccttgcttcttcagttatctttttccgaaaaactatggtccgtataatcagggatggcaccctgcttttccatcctttcagctgtcgcttcttatacacaactttcgattgtttgaaacgtgcattaccttgatcaagcaggtgcttgtgagcatccccatgactagagggactcaaagctacgacaattatatatagagcatactttgatgccggtgccacaagcgttcgcccagctttcttggtaaagcctgtactatccctctgctgcatatccataataagacgtttccagct

SEQ ID NO: 7698 - DNA, 307 bp, Bacillus thuringiensis
ccgtacagccgccgccctttttttttttttttttttttttttttttttttttttttttttttttttttttttttttttagggggggagaatggctaataatttttgaataaaatttaactcagcctcggggtctggatctttggcccacacccctttttggtggtttataccacaaaagagctaagattccatggatcggggggatgtcccgaacaaggaagggttggattttttactggagagattggtgaataccccacacaaataggcctttttgggccctcatttgggggggttgtaaaaaaa

SEQ ID NO: 7699 - DNA, 310 bp, Bacillus thuringiensis
ggacatctacttgtgctcagcatccactaacggaacaatgggggtctttaaaacagtaatcggtattatccgacccgtagatacaagagaactgtgtataatcacagttcatgctgttatcacatacaaccgcaaagaagttatgaactttcttggttaccagtctgcacgcgttatgtatcgagcgtctgaccctgattacacaagataatgttctatcagggctcagagattgaagtgaacccttggtacctagaagtcaatacggtggctactttctaaattaagaccctttttacttacaaggaag

SEQ ID NO: 7700 - DNA, 237 bp, Bacillus thuringiensis
gccttcgaaatactatcaagatctggataacgagactggcggtattgaaggcgaagtttatacgaagcgctatgaaaaagagcttgagaaacttaatcaggtaagtgatattgatcttctattggttgaaacgccactattaaagggtcttgcttataatggctatttgtctgctagccatatatggcagtttcactagaactccacatcttatgatcctaggtttgctacacaagc

SEQ ID NO: 7701 - DNA, 149 bp, Bacillus thuringiensis
ggcccattatattgcgcttaaagacacgttatttgatcagccactgaaataacggcggggggtaggggccaagacacttccaatgcaacctacaaaacgtagagcaaagcacgcatgacttgccggaatagctaataccggaagcgaac

SEQ ID NO: 7702 - DNA, 374 bp, Bacillus thuringiensis
gcatgaaagcatctgtctacgccaggggagaaggtggtcacatgggtgtaggacactacaactcgtatactggctgactgaacggaatgacctgttggccccttgtgtaggtggtactatagtacaaaatggtagcaagaactgttatgccagaaatatggacattgcggctgcaaagaacagtgtgagcaaaaggactttaaaaaggcatagctacccataaaaaggcctctatctatagggaatttatataggctcagtatctttgcccaggaacataaaaattgtatcatctgtcatatgcgcagaacttggacaggcttatttatctactacaaaattccaaaggcaagccaccccactggcttgtccat

SEQ ID NO: 7703 - DNA, 120 bp, Bacillus thuringiensis
gcacagcataatacgccgcaccaacagcaacatacaagggtgtgacatttaaaaaatcaggggcatagctaacaacaaaaagaacattagaaaatacgacaccgtttgcataaggaaaaa

SEQ ID NO: 7704 - DNA, 144 bp, Bacillus thuringiensis
gaagttttttttcccgaatgagctcgctcacttagaggggatgaattgagctcactggccgttgctacatgcgaaaacctgttcggcactctggatatatgtattacaccacgcgcgagtagagtacgaaccagcgtttgacca

SEQ ID NO: 7705 - DNA, 191 bp, Bacillus thuringiensis
acagatgtctacatcataatgatagagcacttcgtactataaaggagatgagatgattgtgagccttttataaaccgtcttacaacaacggtgcctggagccgtcacgtataactgggaacacgttagggtttatgcttctacatcacctgctccaggttatatttttggacacacttgctgaatttacta

SEQ ID NO: 7706 - DNA, 145 bp, Bacillus thuringiensis
aattcgtgatcccaattatttaattcttcacccctttttcaacccccccccctactaaacaaaaaaaaattttaataaaatcacgcgccataaaacctctctccatatttcacctatcacccttctaacacatacacatccttat

SEQ ID NO: 7707 - DNA, 305 bp, Bacillus thuringiensis
gcattaaagaattttacagcgcgcgtggagaggtgcttcatgtggttagcattgatttacttctggcagattgaccgacattgctagaaaagcagccgggaaagaggaaggatatctacttggtgtgaactagactgatacgcacataggaaagatagcacgaccagcgatgggcggaagcttatgggaaatgaatggccatgatccatatacaggctcaggcgttggctaatagcagaggttgcgattacatgtatggggagagagaaacagacggttgaaagatatgtgaagaaatcagaccg

SEQ ID NO: 7708 - DNA, 315 bp, Bacillus thuringiensis
  unsure (1)...(315): unsure at all n locations
catttcataccattattcttaaaacaccngatggttactacgaagctgcaaactatcacgacgtttttaacaatataggggtggctaaaagcggccactccattaaaagtggatgggctgaactgtcattactactactgtgagcaacagtttaagtctttgggagttgaactgaatctgcagaacactcatatgttcaatgtcctaaaaggataatcctttgtatttttaggatttgactccgacactaatacctaacctaaataagaatgaaccctccgttttcaccaaccccaataacaaagctcgcacgac

SEQ ID NO: 7709 - DNA, 403 bp, Bacillus thuringiensis
atattggtaacttgaattcaaatgcactttgctacactcatttttcaaggacacgacacatgacgcttaccgaagcctgttatgacacttcgcaatcataatcccaaacagcccatgtaatatcggcctttgccatgtaccgcctgtttaatctgcggaacagacccataaaacttatttcacatgagaaaactgagcctttaatcgcaacagaatctgcaagcagtgcagtacatgctgttggagatacaccgactcttacaactatcctgaccaagagcacgcatccactagcaaacacacctggttccaacgttaaattaccacctgaactttcattcgtcctcggttgcggaccccttaataccatcccacaacctggatcttagaccagacagcggga

SEQ ID NO: 7710 - DNA, 357 bp, Bacillus thuringiensis
gcagatttttttgcccaatgagcgagctcacttagaggggacgaattgagctccttggccgctgtaaaacgcggaaacctgttcagcacgctggattaatgagttacaccacgcgcgcgtagagtcaaccagctattgccactctaccgatcctcgtcactaactacacgactcagtagatcagatgtggctagcggcatcagctgactcaaaggcaggacttagcagatatccactgatataggcgataacgcccgggagatcatgcgatcaaaagagccagcagctggacacgaaccgataacaggccgcgtagctggcgattctgcatatgctacgcccccacgtccagcatca

SEQ ID NO: 7711 - DNA, 142 bp, Bacillus thuringiensis
cacagaagcctgctttgcaatagaaacccacacaaacggggggaattttgaaactagaagggggacaactctaaatgcacttcactcttctgcatacatggcagacccaacatggctttcttgcaaggcgtccgcaattgca

SEQ ID NO: 7712 - DNA, 315 bp, Bacillus thuringiensis
ctgtggatggtctataaattatgcgatatatgacgcataagaggattgtttgacatgcatgggatgagtaccagccgaagtgactgattagtcacggtatggataaaagcgaattttactcaggaggagaaaggtatcattttgtccatttgatggccgttcagggactaaagaagctaatggtgaagtcaagcatttcgatatgtaccattcaaaggcaccttggacgctacgtgaattaatgggctcatagactgatttatgcatgacggaagcagtgcatgaaacaacaataaatagctgatgtggaaaatg

SEQ ID NO: 7713 - DNA, 234 bp, Bacillus thuringiensis
gaggcacgagacagctcgactacgaaagcagaccacgaatgtaacacagacgaaacgagtgctcatacggcgcaaataaaggaacgaaccccgcactacgcaaagagagacgcgataccataccgtgaatggctgcaacgggaaacatgacgcgcagacaaccgaaggcgaaaacaggagcatttagaagatctgaaatagaaggtggggagagaaaacgaagaagttcaaaga

SEQ ID NO: 7714 - DNA, 303 bp, Bacillus thuringiensis
ccaaactcaccgtaattaatccatccgtcctcttccccaccgccttaccagaaatttcagagagcattttaaaacctccaggggtaaacactttcacaactttcgcaataccaacgacatgcgttcctgatatataatcttacactctttcatccttatccacagcttacaaactccttgcacacacaattgagagaaaatgccctcgtatcgcaaatgccatttcactcattatcattcctaccgactattccatacatactcacgcctgaccatacgcacatgttcattcactacctctgc

SEQ ID NO: 7715 - DNA, 182 bp, Bacillus thuringiensis
cacgccacccgtgaaaaacagcgctttcaatccaacaagcggaacaatttctagaatggagtccgttacgaatacactatccgcaaacagcataataattttttgtaaagaaaccgtcctatacttatatagtcaaaagctcagcacaaatgaatatatacgcacgagagataccatgtaaa

SEQ ID NO: 7716 - DNA, 216 bp, Bacillus thuringiensis
atgtaaacacaactggtcgtgaaaaacaagcgaatatagggggggggattttgaaaggggaacggggctgtgcaccaagaacatctaaaagactagctgcatcaacaacagtttgacgtccaaaaaagcttgtaagaacgagctccagcggattggataaacgagatacaggagaagggttaaccactgcatatattgtgcaaactgtaacgctaa

SEQ ID NO: 7717 - DNA, 260 bp, Bacillus thuringiensis
tttactacaattaagcctttcgaaggggggggagctactacgtagcgtattacaatactaagctggcactgcaatagtggcatctcagctgatcctacttatgcaaacatagtaatctgcggccaacgcacaaatacgagaagacgtttctgtaatacccgtcgtgagacacactaggaattcctgcatctacacacgtttcgagtaacggattttggcgctggtactacgccaagtaacatacattcgtaaagaagaag

SEQ ID NO: 7718 - DNA, 101 bp, Bacillus thuringiensis
agtatcttattacctgatcaaatgtcataagccgttcgtgtagataagtgccaagtggttaccattgatcaagaagacctagaatggttacctgaaacatt

SEQ ID NO: 7719 - DNA, 265 bp, Bacillus thuringiensis
tgtgcctagcgatttttggttctgcccgacaagaagcaccagcaggggcggggtacttttcacaactggagctcacacgtcccacacatgggcaagaaatcacggagaacactagagcaaattgcgaactcctgaaccaggaggccgattgttagaataagggctgatagaacacatgtgttcaccgatgtcgggacgggagtaggtgcagtgtagaacacgaggttcctaataaagaacttggactcgcaacgcgatatggcga

SEQ ID NO: 7720 - DNA, 242 bp, Bacillus thuringiensis
gtgatcagaagactccgacgccgctataagttcgtgcagttttgtgtgggactaggggccgaacttacccgggggggaccccgaacggacggtgtcacgctttaccaatggccttcccggttctggcgatagttctacaatttgcgtcccgcacatttgcctggcgtctttgcacatggcaggtcggctctttaactttatcgggggttatctttacgacactctgaacgatggatgggcac

SEQ ID NO: 7721 - DNA, 233 bp, Bacillus thuringiensis
ggccatgtaatgtacatctttaaccgccaatatctagaaaagataaacctattcctacatggatatctttaaacgatgaatgactcaacaaacgaaaacgctgtgtatttaggtattccgatttggaacccagcttacaactagatagtatatatttcatcctgtagttgcaaggcactaatcgcacttctggctcctgccactggttccctctaaaaaattctttgcttcta

SEQ ID NO: 7722 - DNA, 292 bp, Bacillus thuringiensis
ccttaccctctataccgactccaaacgttgttttttatactgacttaccataaaattcagggggctttttatgaccgccagcgggaaagattttaatagcttgcgtatccccaaagtcctgcgggccagatgaataaccgtacacggcttcatctttctctactgttaactgaccccttgctcccacacttgcgggtaaatttcgccggatcgctgatgcgatcgcactcacttttactgcaacaacctattcggtagataatgcctccttaacaatccccgttctttcatc

SEQ ID NO: 7723 - DNA, 173 bp, Bacillus thuringiensis
ccatataatacaaaggtttgcaccctcttatctcttttccctatgtaaacctgccgaatcggagcgggacatactattactcgttgctcatctagcatgtggtagagcggcgatcgttcataaagagtgatacacttttctttcatatcgtttcgcttattaggaggaagcgc

SEQ ID NO: 7724 - DNA, 137 bp, Bacillus thuringiensis
caccggattgtgctcaacaacaaaatctacaaataacgggaggattttaacgccttgtggggagacaacctcatatgcaggtgggactgcgtcaaacagtacagaaaaatcaagagacccatgacttactaacacaa

SEQ ID NO: 7725 - DNA, 129 bp, Bacillus thuringiensis
  unsure (1)...(129): unsure at all n locations
gaatggaaaaggtgcttagtagttaatgactnttcatctaattgacgtaatgtagctaaagggggatctaaaacatatctcgcggatagctcccaggcaacaatatcaatgctgatataatcctaacac

SEQ ID NO: 7726 - DNA, 106 bp, Bacillus thuringiensis
ggacgacattgcataatgcgtggaacctagcttgtcctcttgagagctgatttggagctgggactagacatggacatagatgatcactgtgtgaacagggagaacc

SEQ ID NO: 7727 - DNA, 104 bp, Bacillus thuringiensis
atacgaagttggtgcctagctgatggagccgaggctggctatcgaccacacgtggggggacgcgagctcgggtacattgtatatattccggataactcataggc

SEQ ID NO: 7728 - DNA, 159 bp, Bacillus thuringiensis
acctaaaatgtcttccgatcaaattgaagccttgctaagatgagttaaacgaatctaatcgacaggcgcctaaccacaacgtctcttatcacctaacacatcaagaaattccaagtgttaatgtcgctaaccgttgcacatgtccccaagcactttgta

SEQ ID NO: 7729 - DNA, 326 bp, Bacillus thuringiensis
ttcggattaaaagatgtctctcattataacaggattactattacagaggaaaacggtgacaaaaaggtggttccgatagcgtatggtggtatacaccctgacattagtggtaaatctgggtactgctttaatgtcactagacgtaccaacgtatacgcgacctacatagcaaacgcagttttacgagggcgtttttaatagggaatataaatcagcgaggcttttcacccatgtattttaataatgagtattaaccaattgaggtttaaatgcctaacatgtaagaaacaggtttcttcatcatagtggaatacaaataatgcaat

SEQ ID NO: 7730 - DNA, 105 bp, Bacillus thuringiensis
aaaattttttttacctaatgagctagctccctcagagatgataaatttagctcctgggccagagtaaaactagaaaacctgttcggcactctagatatttgtatt

SEQ ID NO: 7731 - DNA, 337 bp, Bacillus thuringiensis
cgcattctgcatcaagaccaggttcatattgtaggggaaggagtggtgattgtgagggacaaaaaaccccagtggcctaacggctatcatcaagttaatggggatagccatgtgctcatcaccaaaaaacgaaacacccaagctggttaagagggcaagtaacgagcacgtcgctgcaccaacagtgcctgctcctgtacatatcgatgcgtacaaagttgacttagtcggcgtaccaacatggcctagcactttaccgtagcgatataaaggctcacctgaactggcgatttgcaaagagctcagatttcgaaacggttaacaagttaaggccttc

SEQ ID NO: 7732 - DNA, 417 bp, Bacillus thuringiensis
caaaatgaacctaattatttcaacctttcagtagtccactcatttaacaaaagatacagagaccattttaagacgcagagggtttaacaacaaactatcctactttagctcaacgacatagattgcccatcaaggatatgctgaaaacctacagtagtaaccaccttattcgctgctggcattcacacttgattgttatggaccatagacattaattcaaatctcactcgtctagacgtctcaaaataatcctgtggcttcatcaaacctatcatacacaaatcatagccaacatctctgatgttaggatttaagtctgcaacaccgacatctttcaatggttcaacagccgtattcactactatatagacggtatgcaacactttaccactgcatataacacatactacttttaac

SEQ ID NO: 7733 - DNA, 117 bp, Bacillus thuringiensis
aaatattaccaggaccactcactcgaatttttaattttctttcgcacactgcagatacatcattggagagggaattactcgctgttactccgagctacctgcttattttatactact

SEQ ID NO: 7734 - DNA, 209 bp, Bacillus thuringiensis
gttttttggataacgcgcgtggttatccatcaacgcgagaaattgtagcgcttaccacagtctcgctttgagctgaggaactcgctacacggtcagccgaagaaataatgttacaaagttatatggctgaggacattaagtgaatcttgtggtaatgcagaacgacacctatacgcgcggtagcgaatcgaagatggctgtttattttg

SEQ ID NO: 7735 - DNA, 184 bp, Bacillus thuringiensis
ctgttgaatgctacctctggtaggagaccaattttgtcttctcagctcatgaagaccataaggggggaattgtctacaaagccgtaagcacctttgatcatttcattttgctcatagagcgccgcagtcgttacgtaatcgtgagtgcgtgtccaaaatctgtctcatattaattaaccgacac

SEQ ID NO: 7736 - DNA, 111 bp, Bacillus thuringiensis
acgaaatttatatccacccgataaagaacccaagggggggtatatagagctgtggtcaaacggcacaacaatactaaagaagcatgcgtttggcgcgacagatgcagaagc

SEQ ID NO: 7737 - DNA, 214 bp, Bacillus thuringiensis
aaccaggggtattaatcaatccctacgctacatcatcaacatttgctccttccacctggaggggactctttaataataagcggggcagaaaaattagacattatactatacatcccctatatttcagacaaaagaaaaagcctcccgtgcaccctagactgacaaggctaaccgcgtctatatcctcacaataagctcgctctaaatcatcctc

SEQ ID NO: 7738 - DNA, 129 bp, Bacillus thuringiensis
ttacaacagtgttttcgatagagactgtttagcttactatgccataaccaaagaaacaaaagagacctctacgatgagagggaactctatctcaggtgtaattgcttttgcaccgtcagatcctgaatg

SEQ ID NO: 7739 - DNA, 146 bp, Bacillus thuringiensis
tgataaatatcccgcaatgaagccccaaattccacccatcattgccacaaataaaatcgacaatgggaggggatttaacaatgctagggcgactacataacccttccaatccttttcaagccaaccaactatcatacccaccctat

SEQ ID NO: 7740 - DNA, 285 bp, Bacillus thuringiensis
gtgtgcgtttctaatcggcgctccattactttctacgggcccaaagtgctagcggtgcagagacctcccttttatgtgagtctcgcaaggctgacttcgaatatggacctgtcttatgaccaagcacatacgcacgaactaacactgcttaaactattacaagctacaacactaacgcataaactcgctataacttctgacggttagaaaactacattgaatgatgcctaacttaccgaggaacttagagctttactatataattaagcgagcgcgatttgtcca

SEQ ID NO: 7741 - DNA, 344 bp, Bacillus thuringiensis
tgccacagtgtactccaacaacattaggcgagttatatttgcatacagcatggtgatatacgatgtcagctccgtttccaacacagggaattttcaacttggagcgaccgtttgattatacaataactgtaccccacgttgcctgtggatacatttgcagcaacgattcacatactactgtgcaaaatgaagctacacgaacgggcgtttgcctaggacattcttggctgacagtaccatatccaatatcattagcttttgcctcccaagagccttggtattctacatagtttgtaagatcaggtggtggataaacatatcagctacatgagactgggcctgca

SEQ ID NO: 7742 - DNA, 285 bp, Bacillus thuringiensis
ggagaagccaaaatcggcttttacagcgcggtcaaggaatacatctactccaaaaacgagggacggtggttcaggtcagattacaacaagacgatagcgaatacgccatacagaggaacttgctttgcggtctgttcgcgtggtatcggaacaaatgcctttaatacgtgtcgatttaagcatgatgcggccagttaaactttatccgcgtctattagtatatctgggccacatctcaaaatatctgagccattattgaaatatattgagttaccgacaaaaact

SEQ ID NO: 7743 - DNA, 219 bp, Bacillus thuringiensis
tgtagcagttgactaagaggaccatcacgtttttattactccaggtacagatggacttttggcagtagaaccaaagaggaatgcaccgatgattattcgcgatattggaggacgctacttagggaataatggaccataccaagcgcttgaacaagaaaaggtatactgattcgtaccggtggaaaaatcccgtggacttcgatgtcataactgcggaca

SEQ ID NO: 7744 - DNA, 336 bp, Bacillus thuringiensis
aggcccagggcctgacagagggaaggaccgctcaacccgagggcgactgacaggaccccacaggcgatacagccacacaaaaaaagcgagcctcaaacacacgctgaagaagaaaggaacgacagaacgcacgaagacgaaacagccatgaatgtgaccgcacacccaggagacgagacaggaacagcacggggcggcgactcacgctacgaacgcgcgaaaaccaacgctagggaacgtacagacggagagagaacacgagcgaacacatagccccgaaacgaggcggccgcatgccgcagaaaccaaaagccgcgagacccgaacgcgcaaaga

SEQ ID NO: 7745 - DNA, 154 bp, Bacillus thuringiensis
  unsure (1)...(154): unsure at all n locations
gcgaacagaagctgacagcccaacccctttatanacaacaccacacaaagcagcacacgggggaaggaatgcgagtaacaagcgacggaaccangacacccaaacagaaacagaagaagaacgagaggcaacccccacgagaagaaggcgccaa

SEQ ID NO: 7746 - DNA, 263 bp, Bacillus thuringiensis
atactattatattgatggccccggagtgcgaggttaaaaaacacaacatcgaatattagtgaacctcaccgcttataaatagcacagtttagagaagggaaacaccagcacatcgttgctagaaacacctgcgcggctctctacaggtaaacctaatcggaaacgatttccgaatacggaagtgatacagacgactaacggccatacatgatacccgggtgacactccttgtacagagctgagaccatgaggtcttggtccaa

SEQ ID NO: 7747 - DNA, 270 bp, Bacillus thuringiensis
aatcttgtaatgcatggaaatgtattcttaaaccaattattaacaccatcagatgctaaaaaatcggggaaacgttctatatagcagaagggacatgcatcgctactataccggatacatcctggacattgtccagcgattttggttcaaaaatgtagtggttgcggctacatacgcctataagccccattaaatcatttttaatctacccgttatagagaggggccataagttgaaggggggggggggggggggaaatcacgaatgaat

SEQ ID NO: 7748 - DNA, 185 bp, Bacillus thuringiensis
atacacatggtggacgagcatacatacatacagcgtgagcagaaggtttggaggtgacaactgaacctgatcagcatgctgaaggagatgcaattggacctcgtattgcagatgtcacttttgaaacgcagggctggttttatggggcgattattattgtacaaaggtttaactggccaggggtt

SEQ ID NO: 7749 - DNA, 338 bp, Bacillus thuringiensis
tttgactttcctaccaagcgagaaaaagcgatttttttttatcagcaatgcaacacattacggagggaatcttttaaggaatccgcgttagcaaacactgttttatcggagatttaagcgcaggaattagcacccattcatattctatctagccatcagagagtagtatttactctagctcagacgcaatcgagtcatgcgacctaacacagcccatgggtgagcaaggtacccactcaattaacaaaacgccctgaatagaatggactgcacgcttaatagttaattgcacaatctctatgatcagctatgacgagcaccctaggagatggtccgcc

SEQ ID NO: 7750 - DNA, 477 bp, Bacillus thuringiensis
gtgcattaaaaaaagaattaatacacgaggcctctcgaaagacaattggacatagtcaggggacctctgatgcagtcatacagagtataaccagagatacactggcattaactgcagctgatgctgaacaccatggaacactagaaggtgccattacctttgaggattacgctgaagagcaagctatacaacttggatctgattcagataaggacggaaacttaaccgttaatgatgagagacctggtaatcatcaattagtaaatacgtgggctaccaaaggctttcaatgagatgcatcaccagatacactaaacagaggataaagcccaaacctatagaaatccatatttacaggaatataatagaaaatccgtaatcttcaacaggagagagacgactagccactaactgctccaaattaagacgataacagctgcattgacacatcagagaaacacgaaaacggagctttcc

SEQ ID NO: 7751 - DNA, 415 bp, Bacillus thuringiensis
gtagtttcgatctcaacgctagaccaagctttttcagactaccaaatggactaacaggaggctcctatgaggcatcgccatgatgagagtaacatgcaggagtacattacgtgtctaacatgacttatggtatcacccaccatgtaagactggaacactgcattaggacatctaactgaagcatggcaacgtcatccatacaaagttaaaaactgagaagcgattgaaagtgctcatactggtgttgaaaccaggatgctataaattttagaagacggacgatcctctgggctatcggtgagcagcgttacctataaactctacactatggaacatgacaagctaatgccctacgcagtacagtttccaatggaagacgcgagacttgttcaggcggagatgacaagccaattac

SEQ ID NO: 7752 - DNA, 331 bp, Bacillus thuringiensis
cacatgatcatggcatttggcattggataaggatttttagaaaagatacttggtatactacgtccaaagcttaaaggcgatattggatatatttcacctaaatccatacagataataaataaggttgctctctagtctgattcaaaaatgatagaactcttaaattttactaagcccttcaggcttcctattattctcatgctaattggtgatattgcacgaattttattttttttaatcatgtatagtgaagctttcaaaaagaacattacttcagaaagcatttacgtgaataaggacgaacaacataaacaaatcaccagatcaaatg

SEQ ID NO: 7753 - DNA, 225 bp, Bacillus thuringiensis
gactttgattatgaacccgacccatcataacacactgggaggaaatgataagaagtggcgaaaggttttacaccaattgcaaataagacgcttgttggcggatctacacagtgggtgtgcagcgggaatcttaacggctgcgctcatgctccaacgacctaatctggtgaagaacagaaacttttacatgtgcgaatacgttcctggaaatgtgcatgattggga

SEQ ID NO: 7754 - DNA, 500 bp, Bacillus thuringiensis
gagtgagtattgtatgcattagctccttggaaccatttcgtaaccggcatgataaccgctgcacatggggtgtattgtgccggaaacacccatcttttttgaaataaatgtcctgccttctgcgactatttattatatattcactgactgccatcatcgcctaagcagtccttacgaacaataatctgaattcactgtcatgctcgtcgtgcctagattactttgtcatcacatgtgcagggagcaccagctcgcggtcgttaataccaatgaaggctcctataagggcgaacattgcattggccgtcattatgtataaatgtgactggcttacaccagcagtacccccacttagtcacggtaccaccgattgctctttggccactatggtgtaacatcgaagaggaccgtaccgaacgaccttaccatttgatgggcacccctactgacgataggttagagtgagcgtcctattttgccaagatcgcgttaaattttgt

SEQ ID NO: 7755 - DNA, 336 bp, Bacillus thuringiensis
ctacttctacgcctaaagataggaagacacatactcttcatgaggaaattgcatacactcggcgagcacacgtgcacgagcgtacagaccttttatactctctgagaatacatgcaacggtcttctttgcacatccactagcgctgcctgaatcggtggttaccatttcacgcgatgtcccattcgctttaaacgctcattctaccgcttccggcggcgtccatgttgtttctccagccaagacactttccttcacgcacttggcggacatcatcattcattaaaaaagtttaaatttaatcacttcttttccctcctctaaaacttacccatttt

SEQ ID NO: 7756 - DNA, 409 bp, Bacillus thuringiensis
cctatttctttgactagatgagcttcagagtcgtgatcggttttgcgctggatgtgtactggacggtttggaaacaccgagttatatatgcattgggagacgcggcaaagaacacgactcactatggtgattctaaggttctaaaccagacgcagtgatggtacatagaattcttacccagcatacggccctgagtcagggataccgctattaacgggtgcttttgctgttctttgagctcgccacgtctcttgagagaccgaacgtggagacctgaaagctccgacaagcgctcttctggtgcgagcctgccgagagaagaatacaacttcgtctaccgccctctaatatgtgggacatatatccatactctatgcagtaggaattatatatcgatggaaggacgtcg

SEQ ID NO: 7757 - DNA, 174 bp, Bacillus thuringiensis
  unsure (1)...(174): unsure at all n locations
taaaatcatttttgatcttcaagaaattnnttacacagaaaaattatttctatacaaaaggtaaattaataattatattttatgttttactttatgaatttattgctatttgcacacgttttacaacttcacattatttgttgttatttctgttttttaggcttgactttcatt

SEQ ID NO: 7758 - DNA, 324 bp, Bacillus thuringiensis
aaaacatattttcagtcattctctattccacacttattaaggagcgcttaccgtatgaacagggggacttgttctagagcaaaaaagattggctaccgcaattgaaacaatttctgtgcaaaatgataaactggaaaacgtaactggaagactccgagcagaagtaatcatatattcgttaacactcttcgggatgattgtgaaagtgaaatactgcatactttccgatgattatttttgaaactagttttcaactctaagacacacatgttcatgtcacatagttgtcacacataatcactccaataaagcactaacctttaa

SEQ ID NO: 7759 - DNA, 369 bp, Bacillus thuringiensis
aacagatcttgtttttttactagagatgatctactaggtggtgtggcatggtattgtcaatggctagttctaacacattaagaacataccggaaaatatacgcatggagaaagtctgtttgaccgtcagcgatggagaccgtgacatagctgatcgtctgatcaagatggaccgagcatcgtaatgcccactttatacgcatgttgatcacctttatctgattatattgtccttattggatcccacatgtgaaacgaatacagagggatctttggtgccatttgaacccaaagttgctcttacttcatgcattagagactagtacttttatgtgcatagataagtatgttggccgaaaagtgagtatta

SEQ ID NO: 7760 - DNA, 202 bp, Bacillus thuringiensis
cgaaccagacggcaacgcaagtggtgtgtggtgacaaccacaccgacattccacttaatatactaagtcttttgagatagtaattataagacgtcgcgctgatacatttacatggaatgcacctattacgaacaataatgggaatttgaaggcagggtacattggcctcatctcactctagaccacacgtgtgcctaataca

SEQ ID NO: 7761 - DNA, 425 bp, Bacillus thuringiensis
gtgaagatctatttacaagtggagtacaggacgtggctgcggtgatataggaacggaaaagatgtttcgactcaacggtagctttataagtcatttgtatgtatgagagtgagcgtacatacaactgagcattaacaacgaaaatctgttgtatctatagattataggattggatggagcttataatgtgtaacagcacatgccgatgaccttaagattttatgtctccccaaaacgaaattcttacatgaatatctgtacctttaccttttgatcatttgctttgcaaagacgctctctattcataaaaaccaacgataccacctcagagtatatgaatgaaagccattcattaattaggaaaatggataggaaataatcagggagactaaatgggaaaatattattcatgatacatcatttat

SEQ ID NO: 7762 - DNA, 122 bp, Bacillus thuringiensis
cgtgatgtatcacttcatccaaacgagtgatactcccctttttagcgcagcttatagattgcccgaatggcgggattttaaataacagaggcgtgttcaaaaccatactttcacgcatcaat

SEQ ID NO: 7763 - DNA, 435 bp, Bacillus thuringiensis
tattcctttttgtttaaacatgtgctccattcgtaaatcatttgatcacggcccaacgcgacggagatttttcatacttgaccggggcatgcacattgtggttacccattcccttcacctctctctgttacttttaggaaggaaaaagcgaatgagaatacctacgctaacggtcctactgcggtaccatgcaagaattttcaagcctttgtattttttgggttgcttcatatagtcgtgtaatctttgcatctggtatattacccctctactggtatactctatcgcttaagcattcactacccatatacttagatccgcttgagttgacaccttcatcgtttgcatagcctgcaaatactttagagatctgcagattcttttacataccgaagccctttttgttcaagccaaacctcttgatatgtaaaaagg

SEQ ID NO: 7764 - DNA, 273 bp, Bacillus thuringiensis
ataatagatggttcaaaagatgcatcaaacccatcctaatgtagtccatgaacaaaacatgaatcaggaggttgtgaaagaaaataaggcgcattcgccaataaacaggaagaaagtaacgaaatcattaggagcaacaggcggacaagccaatacatcaaagttactcccaggcgcagtcttagtactttcagcactgagcatgtctgtatttcagaatgagtatcattttaagaattcaaccacgcgctaccttattatatcgctaaccac

SEQ ID NO: 7765 - DNA, 186 bp, Bacillus thuringiensis
acgcgtatggtgaggatcacaattcgtgattcaaagctatcatttgcgcttgtatagttaatattcaaattcgtagattttgttttcgctgggggagaaattgatacatattcctccaattaaaaatcctgttccatctaaaccttctaacgtaacagcattcagttggtttgttagagctgttgt

SEQ ID NO: 7766 - DNA, 239 bp, Bacillus thuringiensis
gccgcacactacgatcgtaggggggattgatagacgacggttcggaaattaaagcgacctgctcattctaagaagcgctgttcattatgctttctcacagtaacataacatctcaagatttgaaaactctttctttgtaattgcctgcagttgacacaacatattaccttctcatacgattattgcggaacaaaatttttgttcctatatgaatgtggagcgctaccataaaacgaggc

SEQ ID NO: 7767 - DNA, 206 bp, Bacillus thuringiensis
attcgtgatattatcaatgtcaggtctatattgaaagacatttcttttaccacatgatacttctctacatggaggaaggttgacaacatcaagaattgaaagaccctcaactagtaacatttgacgaccaataggtattaccatatcacgcatatttttcagggatatgtgcaatacaatcacgttgccaatcaacatctacaaag

SEQ ID NO: 7768 - DNA, 469 bp, Bacillus thuringiensis
tggaagggatgtcgatcatgagtatctaggtatgttggccgagacataatgggtaaccagactgagagtgtaaatcgcccaacagcgtatgcagtgtctggtatgcctacaactattaaacatttagaaggccactttattagagagtctgccgattgatcttcatgcatgtactatcattttgcttggcttacttcatatagattgtccattacttatattcccctaagaagagctagtactacaaacgcatgcatacttgctctatgctgatgagctataaaaaaataagatctatgcatctaattgcactatacataatttagagatttttccatataacagaaatgccggagtgatgctgatgatggcaaatgaagccttgaatgataccggagagatcgcggcgtatttttatgagcaccccattgatagaggcttcgctccatagcgagaagacattgtagat

SEQ ID NO: 7769 - DNA, 337 bp, Bacillus thuringiensis
atgacaccgatcctttttcatcatcttctattgtaccgctttcttttatgaccgcgcaaatagctggtttcactcaaaattaagccatacagcccgaggataacagaacttcttattcggcggaacaaataccattgtaaaaaaggctggcaaaaaggctcctatactaggagccgatgcatgctcttaatatggagttgaatccgactgggaaagagcatttacgcgctctttcagaagacatctgtacaatacatgatgaagattgcttcacggcgactgcaagtacgaataccatcatcggtaccaggtgctgaagctgtactcgcggcgtttc

SEQ ID NO: 7770 - DNA, 257 bp, Bacillus thuringiensis
attcgtgatgcgccaccgcttcccttttcttaaaccactttttttttctagcaatgacccataataagtggaatctctattagcctgaaagaacggcctatttcattcttttaacatccatctatttaccctttgtgtaacaactcaaaacagtcgatctttacatgattgttggttgtgaccataatattcttgtgacctccatagtgtagcatcatcaactgatagcttgtatattcgtcatgggacatcactac

SEQ ID NO: 7771 - DNA, 376 bp, Bacillus thuringiensis
ctacgattatttcacgcagatcatgcagggttttttttgaaaccagcacctggtcatcttctagagtataaacggcaaaaggatggcgcgacatacaatctctaaaccaccctgactgcgtaaagaaacgacacttgtgagaggaccctcgcacaggttgatttataataaagacgagcatgcgctagtgaacatgaccctgttaacgcatttgggagaaaatgcacacctgtcataactaagcaacccaaaccaggtggaaccaagactggggaatatcgatagaacagtctatgaatcatataatgtcatggaatccaccatcattgaaaggtgaactgcagacgtatctgccgtacatttcagcaggaaacat

SEQ ID NO: 7772 - DNA, 183 bp, Bacillus thuringiensis
ccagacgcgatcagagcgagtcccgaagtcgtgatgcagtccctgaacattctagttctaaagccctgtatattccaccacagcgcccaaaaggtaggggggctactgacagactagctcaggttcatcactatactcacagtgctattaaggcctctccacacgtcccaagaaagaaaagag

SEQ ID NO: 7773 - DNA, 314 bp, Bacillus thuringiensis
  unsure (1)...(314): unsure at all n locations
attcgngatttgtgttccctaccgttcttttttgaagaccagatttgtgtccccgctgatgacaacggtttatggggcacttttgacctcatagtggttaacatcgcaatagctccaggttggactttgtactcaccatatttaacgccatcatcgaattctggtactgcaacccatccttgctctgctatatcaatagctacactcccatctgcaaatgtttctgcgatgtcattcgcaacttgaatggattttacacgagccgactggcagagattatcatcgcccatattgaaatttgcaaataatgcctc

SEQ ID NO: 7774 - DNA, 178 bp, Bacillus thuringiensis
aaagatgccggccaactcatatagataaatattcgctctaatcaaaaaggccacttccatgggagggttttataaaattggcggcggtaaaaaacccacaacaattcagcacccaagataaatgaattacaccacccgcccctagtgtcggaccagcatgtaaacaaccggaccgacc

SEQ ID NO: 7775 - DNA, 152 bp, Bacillus thuringiensis
ggaccaaacgcttcttagcccataccaaaaggggccagccagggggccattctagagggagacgcgcgagacaaaccgcggaaggccaactgcttactctccaggcgatctagcactcataccaggtagccgaaacaatacgcctatgcgcc

SEQ ID NO: 7776 - DNA, 150 bp, Bacillus thuringiensis
ttctaataggttcagtatatgttccgacgctacttttgttaagtgccacttgccatccgttcacactggcgccatatgaactaaaggatgagcttccaagtgaaaagataaggattgcaagcggtaccacagcccacatgatgtcctact

SEQ ID NO: 7777 - DNA, 251 bp, Bacillus thuringiensis
ctttatctataactgttaacgctacatccatatcagcggtatacattactatttttctgcacaataacaacctagacttcatcaagtggacgttagtggatcactgcctgttattcataaatccccatctacaaaacaccatgggatttcgaatatttactaaccgtacataagagacagaggttacttgccttcatacgctttataagatggcaactacaacgaatggggggcttataaatgaaacatac

SEQ ID NO: 7778 - DNA, 229 bp, Bacillus thuringiensis
ctgaaccttgtttatcccataaacgaatggaccccttggtggggtttctaggacgttaccagagagtttaacaccctgagattttttacccttttcaaagtagcctacgcaattatataaaggtattgccgccacattattttccattcccgaaagatctgctattgaaattttgatggatttaacagccgaagagctcgacgtattaagatattgctgtctcaatacc

SEQ ID NO: 7779 - DNA, 183 bp, Bacillus thuringiensis
agagaagctggccgcccaactcagaacagcagatttccttcaaaacaagaaaaaaaccccccaccggggggggcccaaacaaaccaccggcccaccacaccccccaaaccaacaaaacccccaaaaacccaaacaacaaaccgaccaaccaccaaaaaagggcccacaccccccacacaaaaa

SEQ ID NO: 7780 - DNA, 234 bp, Bacillus thuringiensis
acaagccggtcatcgcttgcgcttcaatagtaaggattgcaggattattattttgaatagatggagtattttcagtaacataagcttttcgatccatagtatagctataattgtatgtattctgcaatatatacacgatttatctatagattgccgatggaatttaaggaatctgagaaaagagtctcacatatgatttatacttaagtagattattagggcgaactgcaaaca

SEQ ID NO: 7781 - DNA, 193 bp, Bacillus thuringiensis
gatctgaaactacactcactgtgtaagagcttgtttttattctaatcacgcaacaatactaaactgtcgtttcaaaagtcatcagggagcccctcttattataaacgtgaagatttctaattaccgcactaaatgtctaacgagcataaattattacaacggtcgcttagatccacattatattaaaacagcg

SEQ ID NO: 7782 - DNA, 367 bp, Bacillus thuringiensis
ggcaacgggtgtttaaaaggaactaggtcacgcccatgggggggacttttttaatgcgcgggagtaaaaaccgagacacttatcggagcacagggtgctggtgtaaaaccagacagtactagagtaaaacgagcttttaaccaatcgacactcaatcgagacctgggaagggccgacagcaccatagagagtgcatgtggcgccatcgattggctcggaggcggactcgcccactaagaccccacaggtcgagacattccgggggaacatcgtcgcttcaggttcagaggttccgacgcacagacaagacttacatcatgagagtaacatgcatatggtacgctcccagggacagtttacccacttt

SEQ ID NO: 7783 - DNA, 293 bp, Bacillus thuringiensis
ccatactgctgtttttttgactgtaaaaccaggagaaacaattgtttttatatacaattgacactaagcaagccattccttaaaggtctctgacaataggttactgttcgttacatgctttggtgaatgtactctatcatttcggattgatgatcctatgaccgaagggactagatgcgcttgtgttaacagatgctatactattaattattatgttctacgtgattctaggctattgcgatcagataaggatgatgctaccgtgcacacttgttctctaattaatgggaatg

SEQ ID NO: 7784 - DNA, 228 bp, Bacillus thuringiensis
aggtctcccttgtttgttatgtgtaccaaaagtttattggcacaacaatcccacctattaagggtgggacgcttactatatattcggaagtctctttttggcgttatagttagacccatcagcgccttcgaatggagcagatagtaccaggctgtttcatcagagatcgagtacatctagctaggatagcgccttatttttagtttactactgttacaaaggcttccg

SEQ ID NO: 7785 - DNA, 285 bp, Bacillus thuringiensis
ttcccaccgcagctcttgaagtgcaccgaaaagactctttcccaacaacacccccttttcagagtgggaatgacgcaaaccagttcgaagtgccttcttgacgacctaagccgacccatcacgaacaagctctggaggctctagtccaaagatgattcgttctatgtcaataacacatagcattgaccgcccctcatttttaatctaaaacttatacaagggataacaaagttgggggggggggggggttaaattaacagcaccttgatcatcaatctcatctac

SEQ ID NO: 7786 - DNA, 128 bp, Bacillus thuringiensis
gatccctatattcaacacgaagagacaacgccaagtattcatacgaaacaacactcatacgaactgggggtggagtagctttatcatgggggcaccgaaaaataccagaatatgtaaatagcgcggaa

SEQ ID NO: 7787 - DNA, 396 bp, Bacillus thuringiensis
ttcacaccgccagtccttatgagctccgaacatatctttaccgaacaatcccccgttttcagggggcaaagaacgataaccagttggaagtgcgtttgtcacgtcctagaccgacccatcacaggcttggtctggaggagctaggccaacgatgatatctcctatgtaaataacagatatcatgggccgctcctcatttttagtctacacgttataccaagtattactaagttgtaccgcctccgacaatttaatcaacagcagcttgatgaacactctcatctacatcatgcaacacaccagcttgtgcatctctgctcgccctgatggcctcgtgcagaccaatgcgttccgtgtctatagtaactacttgcaccgcttcaggatcgcctggtt

SEQ ID NO: 7788 - DNA, 237 bp, Bacillus thuringiensis
tggacaccggtcatccttatgtgcacctaaaatatctttacggaacaatccctcgttttcagggggcaactcacgataaatagttggaagtacctttgacacgtcttaggccgacccatcctatgcttgctctggaggcgctaggcccaaaatcgttcgtcctatgttagtgacacatagcattatcctttcctcatttgtagcctacaagttatgcaaagtattacgaaattgtac

SEQ ID NO: 7789 - DNA, 287 bp, Bacillus thuringiensis
aacaatctggagctcttgaggtgcgccgaacaaactcttaccgaacaatacgcccttttcagggggggaagcacgcaaaccagttcgaagtgtgttcgagacgacataggccgacccatcccatgcttgctctggaggattaagtccaaagatggaacgttctatgtcaactacacatagcatggggcgcaactcatttttagtctaccccttatactaagggtcacgaagtcggagcggtttcgggaatttgatcagcagcagctcgaccataaatctcagctaca

SEQ ID NO: 7790 - DNA, 209 bp, Bacillus thuringiensis
acccttattcaacgtatgtggatgaagaaacagccaaacagattagtgaatcgattgatcccgaattataggggatgggggctgatgtgaacaaacacggaccggtgaagcattacttaatcgcatcgagcaaattaataggtttcaccagtcactaaaagcatagcgatatttaagaccccgaaattgaactcaacaatgtttaattc

SEQ ID NO: 7791 - DNA, 109 bp, Bacillus thuringiensis
ataatgagtcaaataaaagtgtgcttgacttacgaactgtgaaaatgacagtcttttatgatgattcgtgaatgtgccacatattttatgggggtcttacaagaagttc

SEQ ID NO: 7792 - DNA, 307 bp, Bacillus thuringiensis
ttcactccggtactctttaggtgccccgaacatatctttagcgaacaatcccccgttttcagggtgcaaagaacgctaaccagttgtaagtacgttcgacacgtcctataccgacccatcccagtcttgctctggaggttctagtccaatatgcatatctcctatgtaaataacacataccattaccctctactcatttgtggcttacactttatacaaattataacaaagttgtagcgcttccccctctttaataaaaagcagctggaccaacgccctcattttcatcttaaaaaaccccagctgg

SEQ ID NO: 7793 - DNA, 280 bp, Bacillus thuringiensis
gaacaactgctctttatgggtccgactaacatgacgcattgggcagttttattacaagtgcttatggcaacggacagacttgagtttacaaggatggatgtcatgcgtactgctacgacgctctcacattgagcagagttgttaacggctatattcattggataaaacgcattggtggtaggccagaatgagccacatgaaaccctcgcatggaacaattacaccggttggggctcatgccgcaccctgcaatgaatttggattaggtgggattaaaagg

SEQ ID NO: 7794 - DNA, 489 bp, Bacillus thuringiensis
cgtgccccccaaaaattcttacccaaaaccaccccttgtgacggggggaacatttgagcaaccataggcaaggcgaccccgacggccacaacggaccacaccgcaagcccccacagaaccagaaacaaactctaagcctggaacgtacccacaacagctacgcaaggaccactgctcaaaacaagcctcccccccctcctatacactaataaacgggggggggggagggtctgaccagtcatctcctactccttcactctgaacatcttctaggacagatgcccgcgcgcgcaaacgatgcccgtaccaacgcgctccagcccgaagaaagcccacgatctctaaacagcatacccaaaccgaccaatcacagccggagcttcgcagccatccttatatccccattcgaaccatccaacagcttctttatagcaattcaatccaacaagaaatctgcaacataaccaccctaaaaaattatcagacccc

SEQ ID NO: 7795 - DNA, 399 bp, Bacillus thuringiensis
  unsure (1)...(399): unsure at all n locations
cccccncctgggtcgccccacccccaaacgaagcaatcagagggataatctatcctttcttaagacgcactctcagttgctgaactaaatagacctatttttaaataaggaacgcctcagtcttaattgcgacgagtggaggggtctctaaaataaccccttattgttgtcgcaccaatttggccagcaaaccaagaggagggagacccccgccaagcctcacgaagggcatgacatgccccgcccaattgctcaatataaggcatgtatatataatctaaaaccgctggcggtaattctaaagctccctgcctccatcaatcgacctcacttggactaaccctctgcacactcccaaaatgaaaagctattaatcccatctgaccaataaaaacttta

SEQ ID NO: 7796 - DNA, 306 bp, Bacillus thuringiensis
ttcgtgaagatgtccccctcttcaaagggaagagggggattcttgtttgcaagaactgagggagatcagggggggtactacactaaccatcaggaggaatcgcaataacggctggtgcggacccatcgcgaacgagctccaggtggtgctagtcccagcatggaacgtcctaagtaaataacacctaccatgatccgccccttattttcaggctacacgtgatacaaggtattccgaaatcgtagcaggtccgacatctgacactagaagcagctcgaccaacaagcgcctctacatcaggcagca

SEQ ID NO: 7797 - DNA, 186 bp, Bacillus thuringiensis
ttgacacgctcactctttatgtgcaccgcaaatatatttgccgaccaatccctctttttcagggggcccatgacgcttgacagggggaagtatctttgtcacgtcctagtcccacccatcccgtaccacgctagggggtactgggccaacactcgtgccttctctgtcatttacagataccattgg

SEQ ID NO: 7798 - DNA, 286 bp, Bacillus thuringiensis
agccatgcgctgctcctgaagtgctccgaacagactctttccgaacaataccccgttttcagggggggaagcacgctaaccagttcgaagtgcgtttgtgacgacctaggccgacccatcccggactagctctggaggagctagtcccaaaatggtacctcctgtgtatattacacctagcattggccgccgctcatttttagtctacacgttatacaaattattacgaagttggagcggctccccctatttaattaaaagcagctcgagcaacaatctcagctac

SEQ ID NO: 7799 - DNA, 143 bp, Bacillus thuringiensis
aaagtttggtctccccaatgagcgagctcactcggggggggtaaattgagcccccgggcggtataaaaacgcgaaaacctgttcagcacgctggataaatgaattacaccacgcgcgaggagagtcggaccagcgttcgacca

SEQ ID NO: 7800 - DNA, 213 bp, Bacillus thuringiensis
aattcgagatatatgcggctcaatccttttgtgcaccgcaatgttattccccgaacaatccatctttttcagggggcaaattacgattaactgtgggaagttccttcgtaactactcagtccgaccaatcacgctgtttgcttttgaggcagcctgccaatgttcttttcttcttagtcaattacaggtatcatggggctgtcctgcgtttta

SEQ ID NO: 7801 - DNA, 134 bp, Bacillus thuringiensis
gaagtttggtgtacccaatgagcgagcccactgggaggggttaaattgagcccccgggcgcgaaaaaaaagcgaaaaactgttcggcactctggataaatgaatcactccacccgcgcagagagtccagccagc

SEQ ID NO: 7802 - DNA, 401 bp, Bacillus thuringiensis
ggctcaaaagcttgtcactaattcatatacaaatagcgttatcccataacccacacaacaatacaagtggacctttttaaataacgttcggtttcaaaacaagagttcaccaacaacaatcttactctcatcctcatattaatccaaaatcactcattgcacctacttctctcaccacatttcttgaccaaagcataccattatttattccccttcttataaataattcatccattcttataacttcatcacaacaaacatataccacgactaacataatactatactctaccacatttgtatcgaaaaaccctctttaaaaaataccttactatgttactaatcattacgctcctacaggaatatctatgtttcctagcttacataatatctaaacttat

SEQ ID NO: 7803 - DNA, 343 bp, Bacillus thuringiensis
taccgcccacaacttttactatccagctcgggacacacccgaaacgggggtgttaattaaaaccttgggctaattcaacaagcctaacactatcactgacaatatctaatgaaggggcccctcattctgaatatcactaaccccccggcacgcatgacatcgggtcataaccattacaaccatcccccctctcacaagccgtgagattcatttacatatatgcatcctgaactgcaccctggaaaattaacgtactttttcacgcgcgttaactcctcgtatagcacccacataaagcccgcatacaacaccatttatatgttaacacaaaatgcaggactga

SEQ ID NO: 7804 - DNA, 103 bp, Bacillus thuringiensis
attcagatctactgcctgtctttcccatgagaaaccagaattctcactggggggataaggtctttcagagcaaagcttttccttgtccatggctatatttttt

SEQ ID NO: 7805 - DNA, 165 bp, Bacillus thuringiensis
ggggatcttaccaccgctgtaaagcaacagtacaactgagtgcatcacgctccatcgcggcgcctgtcaactttactaaatgagatactttaacaaacccaatctagaagaagatgtttccatgaccagttattatcggacgccactcttatgatgaaacactga

SEQ ID NO: 7806 - DNA, 329 bp, Bacillus thuringiensis
gtggtgagcgctgttcgaaaggacattgttgaccgcgctgagtagttggcgaacgatttcctccatatgggaggggattataggagtctagagctgtgtgacaagcgtaaagcagatatggtcaaacacttactaggcggcatcgtgttagatccaggtgcccatgccgatcttaatacaggaaggctatactcggggctcaccgaaccaatggctaaaaagaagagctttccattacgttttggtcctgaattacactcccacatagaaaaatggacaagtgctgaattgcgtagcgtgtatgcacacattgagtattttgcttcgca

SEQ ID NO: 7807 - DNA, 241 bp, Bacillus thuringiensis
cagactagcatctgaaagaaaagcagacatcattgagagagacaattgctatggttaagattaccacgggcgaaacactgcataatggagcgaggctgatgaaacagaagggttatctgccctaaatcaaagacgaaggtgtcgtctagccatggatcagggcaccagttaggctgtcaacattctaatctgggcggctatttagtaggagggtctcaacaaccgctacaagccaaggaag

SEQ ID NO: 7808 - DNA, 388 bp, Bacillus thuringiensis
accctccagctgttctccgcattatagcggacaacatatagggggtctagaaaaaatattggggttcacacacactcgggggggtctctctgatggcaatagaaagagacgtgtttagtagtatcacacaaaagtccacacgtggccaccactttgttgtgttgttataaacactataacagatgagatgagaagagtatcactgttctacaaggggtgttgttcttatattacaaaagaggactcgtatatgaggatcccaaaaaaatccatttaaggagggggttcattttaacgccttttaaaggaagctcacactatatatattgtggtttgctcaatattacacagacatgtcacatctattgggttcactttcgaaaaaaag

SEQ ID NO: 7809 - DNA, 207 bp, Bacillus thuringiensis
ccccccgtgtaaatgcataatttgaattatcagttaacgatcacttgttcactgtcgaagaaacaccatattgaagaagccgtcaagacgacatattaacgaaaatgagttggtatccacttttagatgcataaatgcaacaatatttcactaaaaaacttgacttacttccggcgagctttttttatgagactttatataaatacc

SEQ ID NO: 7810 - DNA, 101 bp, Bacillus thuringiensis
cgcgggcggaccgaattatgatttgaacgaaacgtatgcttgtgtcactgttcaaaatgcataagggaaaggcatctacagataagacatttatggagatt

SEQ ID NO: 7811 - DNA, 389 bp, Bacillus thuringiensis
aattcgtgatggaagtagaacttgtttggcggaatgataaggttcaagcgggcggatagcatatgcgggatatacaggctggaagaatcttattacaacactgcgggctcaaggtggaacaacacatgtcacgagcaggggcggaactggattagatgaaaaccgaaaacgttataaggagtaggaacaaaggagaatgcactatcggaagagccggtgcaacgttatcgaatgaaacaagctggcagagagaaaagagctgaatcgtatgataagaacggagtcgacttacagttgaacatacgcaacacctgggagaactcgtgcagcccatcgtgaacaaaccgaacgatgaacacaccatgaaccatactgcgaatctgaaacca

SEQ ID NO: 7812 - DNA, 166 bp, Bacillus thuringiensis
gacatccatttctccgtaaactctaccaccgttgacgtatacattccactcaaccttctactactattatagcatcaatcgccacgacaactcattgggccccaaagtgtgctgactcaacttcaatacgctcgggctctcacactgacgctgggataattgaaac

SEQ ID NO: 7813 - DNA, 328 bp, Bacillus thuringiensis
  unsure (1)...(328): unsure at all n locations
ataggggatctcaccatcactgnaacgcgttacgacagatgatagaacaacgctgtatcttggtacctatcaactgtgcgaaatgataaacttgaagagacatactctaaatgaggctgtctgtttttacattaagtaatggacatccctcgtatgttaattcagtgatactatagagaggattatcggagaatcagtgatataccactcatatagtacctgctgtatgtacacgacctcaaatgagtgcctgaacatcagcgagctgcaacgtgactcggagatcattgctcttgagagactaatgctacttgccacttaaagtgtt

SEQ ID NO: 7814 - DNA, 296 bp, Bacillus thuringiensis
gcgtcatcttttggattgctgtaagcggtcgtactgattgacaatcatactgctgacaacaaccagtagacaccatgcgctggtcctactgaactgaccgatattccaagcttcctgatggattggataacgccatgcgcccaaaaatgtccggaagttctctgaaatccaaacttagactccgctcagaaaaaaggtgagaacgagcggcatttcatatgtaacgcctcgtcacgaaaattccacaaacgtgcgaaagatattcgatgtgttgagagtacgtttacaaccaccta

SEQ ID NO: 7815 - DNA, 334 bp, Bacillus thuringiensis
catacgagcctttgtgcatcgaggggaagcctgctacaccgggggagttgtgaactcacagagggcattgacttgcgctcaactgaccggcaattagcctggatcctacgccagccatttgcggaactgcgttggaacaacgcacgagaagctgtccagcagtattgtagccactctgaccgcgagttctttacaggtgacgctactgtgctcgcgactttacagtgtgcgaggggcgatgtcatgtcactcaaaggcgggctgaacggtcatgacacatacatctgggtatatctgcaggaagctacagtgtgatgctgagtcacaaccagag

SEQ ID NO: 7816 - DNA, 168 bp, Bacillus thuringiensis
gatcttcccaacgcttgaacgcgatacgtcagatgatagaaacacgctgtatctcggtagctatcaactttacgaattgataaacatgaagagacctaatctaaaggaggatgtgtgtatgtagattaaaacgtggacatcactagtatgtcgattcactgtttcttc

SEQ ID NO: 7817 - DNA, 300 bp, Bacillus thuringiensis
  unsure (1)...(300): unsure at all n locations
ggccgagaagcnngcgacaancagaagncccacccttccaancgggagacagaacaagaaggaaccaaaagagagagggggccaaacgagccgtatagggtgaaagcaccccgcccaggcggagcaggcaaacaccgccgcgaagccaccccggacccagcccaaccaccatcttcagagacaaccacagcagccgacccaaacgaggcagagggccgcaaagcagcagaaaggcccaacgacccccgagccgaccccgcaaaagccgacgcaacggatccaccaggacaccgccgcaaa

SEQ ID NO: 7818 - DNA, 274 bp, Bacillus thuringiensis
  unsure (1)...(274): unsure at all n locations
agaagggaacgacaaacggcacganaccaaccgcgacaaaacaaggagagccagggaaagaagcatacgatacggcaagacataagattgaacgaacctataatatggtacacgatcatggactgatagcgacaggtcgaatgggccagattattcatccatgcagaacgcaaaacccagtcccaggtacggaggttggaaacgggcaatgggtgacgcgggacggcgtacaaacacaagaagcgtgccttatggtctggaggattcatggagc

SEQ ID NO: 7819 - DNA, 378 bp, Bacillus thuringiensis
acgtggtgataaacgctagcactggtgcgcccaccactttatctcaccatcaacaacgcctgcatgtggaattagcttctccagcacaatacgccctctaacgacgcactcccggtctacaagctccactcatgacaccgaaatggccgatatgtttgaaaaaacagatgtgcctgcacaaggtgatgttcacgcactcgaagtatcggcccagcaaaatccaacacaggctgcgcaacacctaaacctagcatggatcctatcgtgcgccctaacatcatacgagccagcccacttagaacagctgcgagagcgagccataacacccgttgctacattctgaccaacaaaggtcaatacacactggtcgggccacgg

SEQ ID NO: 7820 - DNA, 141 bp, Bacillus thuringiensis
gatgtagcgtgcgtggcaccatgctatcactgtgcagcgacggataaaagattggagtcattgtggagataggtgatttctggggctaactgtgatcccgtcacaattacgcacttcatgcgagccgttcgcacaacgtgt

SEQ ID NO: 7821 - DNA, 515 bp, Bacillus thuringiensis
ccggtccggaattcccgggtcgacccacgcgtccgtacgggactggaggtggccttggcggaggctagggcgaggccggcagcgacgggtcctggggttcaggttacgcggcgggaatcggtgctggcactggcggcggcggtggcggcggatcgcaaggcggctctggtggtggcggtggctctgggtccggatccggcagcggtggaatccactgagtttccctgcggcatgcagctggacggagcgctcggcgttagtgtcagtccattttggagtcggttcgtgtacctgagttttccttgaggagatgctggttttcgctttctttgttgcaagaattattagtcaggaataatgggcttcgttcgtgattgtagttcgagtaggtaggtagtccagcatgcaactgacatgtaatggctacaggctactacgagtatatgcttgcatcgccatcttttgatgtgccccttgttgttactctcatcgatctttagaggtcgttgctaccg

SEQ ID NO: 7822 - DNA, 124 bp, Bacillus thuringiensis
ggcaaacgggggtttcccacccctgcaaagcgacacttcagacgagagcacaacgacccatcgtggcagctatcaatagtgcgacatgatgaacttgaacagacctaccctaaatagggctgtc

SEQ ID NO: 7823 - DNA, 408 bp, Bacillus thuringiensis
tcttcctttttttcttttgcttcacgcgccctcggatttacgtttgcttctttggttgcgccgtggtttctctccctctgtggccttcgttggtctactccactttctctgtctggcgtctaatctgtcttcttctctggcgctctattatcccttccctttgggtttccgcctggccctggattttgggtccgcttcgtccttttttgtgctgcgtcttgatgtgccgctgttcccttctgattaagctcttcggcctcttcgtgtgctttctcttggatttgccctgtgcgcgtctcccctgccttggtcttttcgtgcgcttgcgctcgttttgcctctgttttttgctttgtctggggtttttttgctggtggctggtcccttttcggtttcccccgttcgctc

SEQ ID NO: 7824 - DNA, 353 bp, Bacillus thuringiensis
tgatgcctccttcgcctgtggtgttaatactaaattttttctgccctattggaaacaccgcacgtggggggttaatatgcacccgtagggtaccttcagaccctggcaaactcatatccccatagtatcacagtttattgctctcgcggacaagtactaccggattgagcccctagagcgctgagcaactccaattgttacaacggtactgtcaccggctgcacttcatacggctctagaaaagtaccacggtttacatatgcatttcccactcggatcggagggataactgaaaggctgcaggccgagacgctatgattaagactcttacggccaaaggatactgggtcata

SEQ ID NO: 7825 - DNA, 185 bp, Bacillus thuringiensis
aaagggggggggcaacccccgcccgagcacccgcccccacgccccacggcgccaaagaacccgcgcgcacgcagcacccgccccaccaaaaagaaccacaaccgcacaaagcaaaacaacaagaacaccaaccacccacgaaccaccgcgcacaccaaacgaagacacccgcccccgccacgcac

SEQ ID NO: 7826 - DNA, 407 bp, Bacillus thuringiensis
ggctagcatttgatctcacaacacacacattctgatctactgggtggattcttgcttctaactcgtggacattaaataaacaattttcaatttcttttgccaatgtttcgaatccttgaattaaagacctataaacccaagtgctatgccctaaagcttcaaccatttatgaatacaatgtcttacactggatgattactaatcatatgtgtcaacagggacaagacgttttatcaacagcagaaacaattgcttgaattgcatccgataatacattaaactctttagtacaaataccaaagtgtctcaaatacacctagcgcttgtcatgctcatttcccctgttaggtttcatatcaaactatacttgtattacttaatgtaacagaaaataacttacctaacac

SEQ ID NO: 7827 - DNA, 331 bp, Bacillus thuringiensis
ctatccgcagatgaggaacggggggctatatttacttccggtgaagctccaatcagaggggctggcagcatacctaatttctctgaaaggaaaagccacggatgctcaccttctgcccagccgtcaataccatactctttccaccaatttagcgacgtaagtaaagacttatctgctcttttagaaagccgccctaaggagctgccacctaaatatataggaccttctttcttatagaatccagtttgacaatctttcagttcatcatgtccagcacagtcaagcgcatactcataagttggttgaaatggccctttatacatggcggcac

SEQ ID NO: 7828 - DNA, 146 bp, Bacillus thuringiensis
tactacagatgaatgtaactaagatgtatcttggtacctatcaactttacttcatgttaaacttgaagtgaccaagactagatgaagatgtttgtttctccagcaaatcttgcacctcatgactatgactactcactgattcaatc

SEQ ID NO: 7829 - DNA, 443 bp, Bacillus thuringiensis
acctaaccaggtctggacatcctctgaaaacttttgttataggccttccccttcgcgagcacagaggcaggagttgcaaggctgtcgagagctcgcgactggagatggaggtgcacgactatcatagagcgcaaccctatgacatagtcgccatcaataagagggtcactgtataggaacttgtcggcaacaagaccagaaggaagaggtgcgaagacgacaaatagtcatgctcattatgaccaggtctacacacgaggctacagtgcgacggcacaaagagctgtaagatccgataggtggagataaagtcataaaaaccgatcgcagttcggatggtaggcccgtatctagactacatgaagactcgaataggtaggtatagcggatcaacatgcctcgtagaattcttacaacggacttggtcacacagcctctaacac

SEQ ID NO: 7830 - DNA, 369 bp, Bacillus thuringiensis
ttaaatgttccactttgagatcaagtggggctattgtaagtcgcggggggcacactaactggtagggactatcttatctttaaatagcatgtgatgttgaccatggaaataaatctttgctcgatgaaaggcagaaaatattcgcacatggttttagcaggggcaatatgccaaatccaaatgcccctaaacttgtaggaccgacgccttcttgcttttccagattgaaatcacgggacactggaaactgaacatatcggctggctagattgcgtgcacttcttggacgaactgagattggcacatttaccctgatgccgtataactgaaagagaaaacatcctgttcaccgacaatgaaaaggacgaa

SEQ ID NO: 7831 - DNA, 307 bp, Bacillus thuringiensis
  unsure (1)...(307): unsure at all n locations
acgaagnaagcaaaaaggggggggcaagaaagagaagggggggaaacacaaacaacgcaggaagggaaaangcgagaaccagaagacaaacacagaagcaaacgaacanncgacacgaaagagaaaggaggggagacaagccacaccaaaacgcgacggggagagcggcaagaggaaaaagaacacccaagccgacgcaaagcgcgagaagaagaaacacaacgcccgcgagggaaaacaanaccaaaacggcgcgccagaacagaagacaaaccagacgcagaaggcaacaacagcaaaagaggaa

SEQ ID NO: 7832 - DNA, 250 bp, Bacillus thuringiensis
  unsure (1)...(250): unsure at all n locations
tgattcatatgttaactgaactccttcattgggcaatgtttcatcacatgctgaaattaggacaactctgggggaagctgcgaatgtnatgtatggcataaatcataagaccagagattacaatgcgtgaaacatattaagatgggcgtttcagactattcatgatgcatcaagaaagaatggaaagaccacaatgacactacacgaaaacttaatatgggataaagatatggatcatgaccactagtcc

SEQ ID NO: 7833 - DNA, 175 bp, Bacillus thuringiensis
acgcctatcaaaccagggagagaatgcgagacgcacacctgagccaaaaatacaatcagaaaatgcacatctgaagaagaaaaccccaaatgcaccgtctgaagcatgaatacaagccaatcacaatgaagaagaacaaccacaaattgccctaagggtaccaaatgaaacaacg

SEQ ID NO: 7834 - DNA, 141 bp, Bacillus thuringiensis
catccgattgcgcaaggggggttaaccagtggcctgaaccgacaacacttattttgctacacgcttctagcgcgagcgacgcaccttgtgctacgtctggcacactggctggatacatcgcatatcagtcggagccccttc

SEQ ID NO: 7835 - DNA, 220 bp, Bacillus thuringiensis
aacagccaaaaagacggccccaccgagaacaaagataaggcgggcggcaacagcggcggacgaacgaaacgcaaaacgcgcggcgccaacacaacaaaaccacacagaagagaggcgtgccgcaaggagcaccacgacccgaacccacaccagaaagggcagacaagcaacgacaaacgccagagaaacaagcagcaaacccacgaaacgcgaagcccaa

SEQ ID NO: 7836 - DNA, 140 bp, Bacillus thuringiensis
gtacttttcctgtcttgggcacgtagctcgacaactgcaggggtgtttattatgcacattgggggcgcgtatctctattaagcctataacttgcccaattcgttaactctgctctgagtctaaaatcataaagtctcctt

SEQ ID NO: 7837 - DNA, 172 bp, Bacillus thuringiensis
ggttccccgcgggttctccccaccgcttgaacacgatacgacagacgatagcacaacgccgtatctcggaagctatcaacttagctaaatgatatacacgaagagacatactctaaatgaggctgtttgtatatacattacgtagtggacatccctcctatgaaaacgcact

SEQ ID NO: 7838 - DNA, 155 bp, Bacillus thuringiensis
attgaagaacattttccgagcggcaagaccactattttatcaggacatggtatggaacaagtggaggctatgtgccaacatgtatgtattgcgaaaaacggtgaagccgtcgcaaaaggacagctaagcgatattaacacagaatacggactatg

SEQ ID NO: 7839 - DNA, 151 bp, Bacillus thuringiensis
aaaccgtatactttctgaagagcttttatctgcttttttacgactgatcaacctggtttcaaagtcattcatgatggcaaaacgcctattcctgttccatacgctgacccggtgcggtttcgcctatgcgctctgtacttgtttcttcaat

SEQ ID NO: 7840 - DNA, 142 bp, Bacillus thuringiensis
taaggcaatatcttctattaattcacgctctggctgtaatgagaatctataactgcttgatgggggtcaagaacaataatcgttctgtcgccaagtttatttccacatacttttggactcatacctcgtattggatcatatt

SEQ ID NO: 7841 - DNA, 411 bp, Bacillus thuringiensis
ctgaattccaatttgctcagctggtggcttcatattcttcaggggaacgcgactacttttattgccagcttttgaaaagcgaattgcattgaggaataactccgcacacctgtgtgatatctattatccattaacctattttgctgcactacatttgaatagagtgcacaccgtcatacgagtcgaccaatgcctatcagagaagtttccttgctgatatccagattgtctctctgcctagctgtaaatgtgtacttcagatgtgacctatgcactccagtattgatcatgtgaagcttttcagcgcgtcggttgcatgatctgtctcgcatcttatgatcattgcgattcaagcttcactacacccgatatatgatcgatctgccatatgtagaacgcgaaaagaaaatg

SEQ ID NO: 7842 - DNA, 106 bp, Bacillus thuringiensis
taccaactcccgattaacagatgctctaaaacgtttataaaccaaaaacccccggtttcttttgaggggttaccagggtcatcacctaatatcgcagcgtgttaaa

SEQ ID NO: 7843 - DNA, 235 bp, Bacillus thuringiensis
tgatgatcaaattggattttctttagaaatacggccttttgtgtcacgcctacaaacacgctcagattgggggggtgcaccgaggtctcccgcacctaactatactgtggctaactagataaaattgacctccttacgcgcatcaggtgaaagaataggaattgcatatcaaagatttgcccatggcttacgacaccgtgaatgtttcgcgccaatgttgccaggttttctgcaa

SEQ ID NO: 7844 - DNA, 428 bp, Bacillus thuringiensis
cgcatggcccacttctgtcggacttggcttcggtcctgtctggggctgctcggactagccttgggtaagaaaccttatgcattacggaggacgggatggtcacgggtttaaagctacttataccagactttctcactatgtaaggactaacagcacatgctacggccatagactaactgtgctgagaacgctaatgtaccactgactccatatgcataaaaccaaacgttctggggtgtatttaggcacggggcattcattgcgcatagtcactggcctagagagctattacgcactctctaaatggaggttgatgtaactcacatactagtatgtctaagcaacatggacatggctttgccacttaatacacactttaagaccctatctggcggactgaccttgctagctttagactgctgatctta

SEQ ID NO: 7845 - DNA, 118 bp, Bacillus thuringiensis
  unsure (1)...(118): unsure at all n locations
tacaaagnagactctctnnaccaaccaaaaaagacccacacaccccgggggggacgctacatttataaaaccgcttttctctaatcctaaaatttaaataaggttaatgttttataat

SEQ ID NO: 7846 - DNA, 582 bp, Bacillus thuringiensis
  unsure (1)...(582): unsure at all n locations
aatcctcatctactgcggatctatttatcaaatagctcgggacagaattacaatgcttacagattgcccagcaattacgttctaccacttccttaaaaatcgaactcgaactagcaggacgcanattaaaacgtgcccttaattatgccaataaagagaatatcccttatgtgcttattattggtgaagaagaacttagtacaaacactgttgtgctgcggaatatgaaggaaggtagtgagatgaaggttccgcttacttctttgaaaaataatacattgaataaatattttactacgcctactacgttatgactggtgaagtattctcaaaatgtaaatcaggtaaacaaaagggggctgtccgcgcatgacagcccttttcccttaatgaacaacaccttcataagtgaaattatataacgattttccgaatatatctatcataatttacactatatcaacgacattagatttttcatttgatagataaccgggcaattagtttacataaaataattatactcaaattaatcttacanaactttacatccaatacctattttatataatggttttctat

SEQ ID NO: 7847 - DNA, 154 bp, Bacillus thuringiensis
cccccttgaaagggtcacatcagacgagtgaataaagacctatcgtggcagctagcaacagtgcgacatgatctactccatgagacatactcttaagaaagctgtgtctatgatccattaagcatgggaccctacttatatgttgatagcagtg

SEQ ID NO: 7848 - DNA, 104 bp, Bacillus thuringiensis
ctctctgccagtccgctacgccgaattagcgcgacgtttgggggtagagccgggggagagggtcgatacctcccaggtgcgtgagacggtgttagcggtccgtg

SEQ ID NO: 7849 - DNA, 502 bp, Bacillus thuringiensis
atggaaacaagtaccacttttatagccaggttaaatgatataaatatgtaactccaggttcccttccctccaaaaactattctcgaattactccaaccatttttcaatggttgaagtacaattactcagtacaattactagcctattctatccacttaactccttatttcttgtattacatatattgtaatttgccttcaccaagtaattaaggattaacttaaacctgagattttgcactttctctccatgagtaaacagaatcacatctataaaacggacaaaatttacacccctataaaatgttgagcagactagtgaataatttagttttattcaatcattagaaatggactatttctagacccaaagtccacgagaacaatggtatttgtgaactaaccagacaaggctagttaggaaaggaaaacaaacaatgtagaaggaaaatatagaataattaaaaataaaaaaaatttacggccaggtgtggtgattcatg

SEQ ID NO: 7850 - DNA, 184 bp, Bacillus thuringiensis
cagaacgggctcttagttttctccagcgggattacgcctaactacgttaattcctcttgtgcgtgctcacatgttagatattcggagttatcctgctctaaaaatgacttcgctttttctttcgactgttcatataatcctgcaaacatgtgtttacgcttctgtttttccggaagctttacac

SEQ ID NO: 7851 - DNA, 240 bp, Bacillus thuringiensis
acgcgcttttttggaagctgcgaaaaattaatgtggaggtctataagctgggtgcgtcgaatgatatgcaaaaaacaaatgcagtaccagggactatattacgtaatgagcccctactcatctgatttacagctaaacctccgattatgtatggggcgaaaagcatgggtgctggcacagtgtgggacgccataattcaatgtggatccagggagggtaaatcaaaaaagaataatacct

SEQ ID NO: 7852 - DNA, 405 bp, Bacillus thuringiensis
atctccgcttcaaagctctcattttgtgtgatacctaaatactcgagagtctctgagggaataacgggaggaaattgaccgttcgcaagagcgaccgaaatgcctgttttgttctcatgatcaccgaacaataataggattgaatctgtttcttttactactgcagctactactgtttcaagggcctgttggagtacacgatcggcgcttggatccacagatgcatttggggctattttaaatttgaaatctaacatttgtgattatacaccaataagagggacgaaatgtttaagcgctttttcgactaaggcattgacagaaataaacattttaaaagcctgaatttttcacagggtcagcagagattttttctacagtaccggctgcagatactacatgttc

SEQ ID NO: 7853 - DNA, 501 bp, Bacillus thuringiensis
ggggaaggcccatcgtagtagaaaaaacttatcgtgaaacactcggtaaaccccgaggagaaggaggatctcaaccaactacactctttggggacgtcgcgaccatcactgaagcacgcatccatgactctcctgtaccatcatactgctaccggtgctggaattgccggatgcaggctccgcatggcattcaataggctgaaagagtgcgcatagtcagcaattcaacacgacaagaattgtcatcactcgtgcgtagtataaaatagatatgtctaacgggtgataagagagcgttgtgtatcagcgtgcacagtgagctcattctacgaggtgacaacaaagactgtgtatcaatcgagcgcatatacaattgaatgaacatatgctgctacatgggaccacattcatgtgcacatgaatgcgaccgatgtgaatacccgcggtgatcaatggagcaccaagggatatggctgcactagaatgatatggctgacagga

SEQ ID NO: 7854 - DNA, 102 bp, Bacillus thuringiensis
tgcggggcaccgagcttaccctatagagagacgtataaaagctaggcgtggtcaaggtcatagtctgactctgcgcgaaattgtcaaaccgatcacataaag

SEQ ID NO: 7855 - DNA, 105 bp, Bacillus thuringiensis
ttcttccccccgagagggggctctacaccttgctgaactaactttgctttttgaagagggcatccttcatacttgcgaatctcctatgggaatcttcgttaaaga

SEQ ID NO: 7856 - DNA, 208 bp, Bacillus thuringiensis
  unsure (1)...(208): unsure at all n locations
aaaacanaaaaaaaccccccacacanaaaaaaaaacaaacgacccccgaaaacgacgacaaaaccaacacaaccgcagaaaccgcaaccannngccaaaaagaaaagaccccacccgaaccagaccaccaccagcaaaaggccaacccgcgccaggaaccaccagaagagacgccccccgcaacaacagaaacccggacacacacaaa

SEQ ID NO: 7857 - DNA, 236 bp, Bacillus thuringiensis
cgctacaaaatttttttcatgctacgaacaactaggaaatggggtaaccgataggcccgactcgtgccaatccataatcgatctaacgaatagagggcgatctattggactggttccctatattgcaactcgattccactgtcaaagaaacccgactccacctgtgatgggcgaataaccgtctagcggggcaaaggcccattacttgcgccttcacgctaattaggatttgcggg

SEQ ID NO: 7858 - DNA, 132 bp, Bacillus thuringiensis
ccccccctgtaaggcggcactacagccgattgaacaacgctccattgtggcagttggcaacagtacttcatgatctactccatgagacaccctcttaaaaaagctgggtccatgtcctttaaacaaatggac

SEQ ID NO: 7859 - DNA, 343 bp, Bacillus thuringiensis
  unsure (1)...(343): unsure at all n locations
aaggaaggcggacacacaagaaactcggcaacganagaaacgaaaccngaccggaaanngagcacgaggcgaacaaagccaaacaggcaaaagaanccaangagaagnngngccaacacacaaaaggcaaacggggcggnaagccaaaagaaanggaaaacnggcaaaaagccatgacagcagctaccctcggaaacgnncataaaaccgaagggacgagaaaggatagagaaggactccaaagagaggctcgaaaaaatggaaagtcaacaatcgcttctggaaaaggtcgcatttgcagcagccgatggagaaccaggagcagaaaaatgcaggtgctact

SEQ ID NO: 7860 - DNA, 458 bp, Bacillus thuringiensis
tgggctcgagaggctggcccccaattcaagttaaccccaccctattttcttttggggttccccctttaaaaaaacgttttttaaaaaaccctccttttaatgggcccatttttggaattaaagggtaaaaaaccgtggaaccgctcgggggaaaaatttcacaattttctccctaaataacccaattcggaatttttttttggcccagtatattggggcgcggaaccttggggggggccccatttttaagggtaaaaattcctttgggggggggctcacaattttttattttaaaccccgaaaaggttggggccctggtgaaaaaatttccagggccccccttttaggtaaaccgaaaatccgtttaaggctcatcaccggccataaatttggcccggggttttttccataaaaccaatggggggctttaaaggcctggctttgttttttgggtaggg

SEQ ID NO: 7861 - DNA, 278 bp, Bacillus thuringiensis
accctccaatgtgtgtggtatcacgtatggccatttacttagagggattcataaatcaacgtgtagaggatcctgtagttacacctgaatctgcagctccctggattacaaagcgggatgacttcaggcttaagcgtgtccacaccggcaggagatgaacaagcggtcccattcgcgcctgcacaccgtgttaagactgatgcatcttgaacaggtaacgcctatactggcgcatatctcggctcggatgtagactaccaatttgctgaagcagtcat

SEQ ID NO: 7862 - DNA, 310 bp, Bacillus thuringiensis
gccaccaaatcacgatagaacgcggtgtgttacctgtaccgatcacgaatgacaaggcgatattcaaagcctttcggatagtgagcccgattataacatgacggaaccatgctcatagatcatggctgtgtgaaataggtatacggtcacaaagaccgacccattccaggcggtaccttaggagtgcaaagcctggagcgccttatgagttagctaactaacattaatagtgctaggctcactgtccggttaccagtcgaaaacccggctatgccacatgcatgaatgaattctgctactcgcgctgaga

SEQ ID NO: 7863 - DNA, 387 bp, Bacillus thuringiensis
accacgaagttttttccacagacgccacattctatcacgctgccaatttaaaacccatacaggttctgaacaccagaaaacattgcacgcacctcagtaaatatagaaagctcacttcaataactctcctatacaatactcacacgcatgccactccgctaacataattatggataactgtacttactaataagtgagccttctaccaatatatgctctgcgctaactcacctgtttacagtagaaaaacctgtcatgccacatgaattactaaatcaaacaactcgcggttagaggcttcaaacccaattgaacgaccattcacatactcactcactgactcgatacgctataccgatctattccggacagaaccatcagcacact

SEQ ID NO: 7864 - DNA, 210 bp, Bacillus thuringiensis
  unsure (1)...(210): unsure at all n locations
acaaacaccangggggcttgaaaaaaaaaaagcgggaaaacacacgaagaaaatgccacataacgcgcaactgaatgaccaacctcctgatgggataaaagggagtacattacacataaataagcgaaccagagcacaacccggaccaagatactgaaatcatttgcagaacacacacaacagaacccccaatacaaaataacgcatgaa

SEQ ID NO: 7865 - DNA, 401 bp, Bacillus thuringiensis
acacgcgtttgttgcgatcacgaacgcgggatggagcgttatgcaccgctccaagaaaggcatgcgatttattggctcaacaaaacacaagaccatttggaggagcttttgaaggaagggccatgtacaacaaaatggatggacctatatttagtaaaagctgggcaaaaagggataacagaactagggatagttgaaaattactatcgacatcatgaagcgaaaggatattatgataaatacgaacagattagtgcgcctaaactctaccgtatgcagaaggaatgattagatgaaggtatgcaaggttcactgcttgaaatgacaaaggtcatataacaggcgaaagatccgtgaaaaaaaggaggtgtcacacttagactttgaattgtagcgcacta

SEQ ID NO: 7866 - DNA, 150 bp, Bacillus thuringiensis
aaattcaactgtcgttttacgcactaccagccttacatgacataaggctggcttgccaatttgattcacgaatctccacaagctcccctggagcagggcttttgccataaagaacgcctatgcgctactggagtaactgactggcaaacc

SEQ ID NO: 7867 - DNA, 294 bp, Bacillus thuringiensis
cacgaattacgatgcctatacgtaccgatttatatgcatgcgtggggccttaactagcgtattgagtgaaagataatagcaacgattatgcattgaaatagctgtttcctggataaatgacatccggacacctctagccacatcatccgatccaaatgcataaaatgttaaggcagaggtgccccatgagggaactagctcacactaattaattggcactcactgctcgacagccagaatcataacccagcttatcagctgaaacaatgaatctggcacagctcaaggtgaagc

SEQ ID NO: 7868 - DNA, 313 bp, Bacillus thuringiensis
aattggaacatccttgctaatggcatcggggctccgacaatggaataccgagatggactcgcccctggcgcgcggcgctgacttgcaccttattccgccgtcggagaccttgtgatgttgacaggcggcgaccctagctttcccgcgtgtgggctctgctccagcgcctatgctttcgctgctggatgggtcagtggatgcaatgctctgtgccgctgcacggatttaagagggccacttcgtcttgcaactgcgtggatgtgtgcgctaaatgtaggttgggatcagaaggactcaggcttcggctcactta

SEQ ID NO: 7869 - DNA, 355 bp, Bacillus thuringiensis
  unsure (1)...(355): unsure at all n locations
gcgcgagacgcggggccacaaacacagataacagaanttaagccgagacaaaaaaggcaaaaagcggggggcctgagagacgagaccgggaacacacgaaaaagcagcccgcccagagcaagcngcagagccccagggaaagggagaaaaagagggggnacgccaaaaccgacaagagcggcaaacagccngagaacacgacagacagacnaaaaagcccaacagaaagacgaacacaagaaaaggcaggacccaccaggannggaacagcaaggccagaaccaaaagaaggggccgcgcaaacaccactaaaagnaagaacacacaaaaccaacgagggaagcgccggaaccaa

SEQ ID NO: 7870 - DNA, 352 bp, Bacillus thuringiensis
ttttttttaataacttgcatctcataatccgaaattttttatttccctttttccttcgcagagcatgcgtctctattgattcccaatgcaattgccatttctgcaatcgtgatatcacgtgccattctttctctttttaaaattcgtttagggcttaagtataaccattcgaattccttttttaacagccattgtgtcacctccgcatatctgcctgacccgataatatcgcatatcttagataacattgaacctacacacaaaaataatcttaccctgtacaatatttttattgcgtcacgcgttactttagcgcatactatccttatcgtatcaatggacggaggtcact

SEQ ID NO: 7871 - DNA, 293 bp, Bacillus thuringiensis
ctggtgcctggggtcgtgatgagcgtctatacctatcagttctggcggatccccattttttcatgcggacactcggcatgacgagggggctattatttcaccactaggtgtgctaactgcgcattctacactagtccatacacctattgtgccacctttaacgcttcctactgctcagctggtggacgtcggattgccacacaccactcgactgctaaactctcactataaccaagcttggtcatagcctctctacccacgggtgatcctatcatatcctcaaaggaaaggac

SEQ ID NO: 7872 - DNA, 278 bp, Bacillus thuringiensis
aactccattttctctcaattattaagcataaatccccgggttgacctaaatcaaacacgcgggctttaaacaagccaccgctgagaaaatgctcggtctaccacctacaacacccaaaatcactaataccaagacactttgtcctatcccagaacctatacacaccatgaacgaatcaagccactttgcctctcataacataatcaaagacgaaacgttgcgctcgctttattataaacccgccgaacaaccacttaccattaaacaactcattccaa

SEQ ID NO: 7873 - DNA, 375 bp, Bacillus thuringiensis
cccccaattccaaataaaccaccttttttgttttaaaaccaaaccattggtttaacggggggcttttattaaccccgggggaggcaatttagcccaagcccccaaaaaataccccttccccccctttggcccaaccccaaattaaagggtaacgggctgggccatgcaaaccccaccccattggatttttaaataaaacccaatggggtcccataacgtaatcaaaaaaaacaccctaagcccgttaaaccatatatcggtcgcggaagcacatattaaaaagcgattcattctaactactatggaaaaggaatcggaacaaatgcaaaacatctctgaattatgtaacattatctcgggggcagacattattac

SEQ ID NO: 7874 - DNA, 262 bp, Bacillus thuringiensis
ttgaaaaaacttggtcctaacactagaagcgtttgaagagagggggctttttggcgacctcggtgaataagaagcatctgactacagttatgcttcttctgacattgtatccaaatgcctattcggatgcagcgatctttggtgcgttgcaatctgtacagacttcgtctttaaacgtatcatgatacactcaaacgaagactttaactatttcgagccacagacgaatgatcgtttcgtaccttactgcatttcagccatt

SEQ ID NO: 7875 - DNA, 295 bp, Bacillus thuringiensis
tttaataccaagaccggtccaacaaatttctgcaccgattcgactactaatgccgatagttactcagcatggaccattggaacgtacagcatcatgcactattccaccttcattgaaatctatacaccatcgtcttacacacatgtaccaaaaagctaaacttactcgccaactgcggactttgctattccccatatgtatgaaaaataagctataatgctacgacttgtcacgagataattacttataaagatcaacttctattcaaataccaaccatttgagtctgcacacta

SEQ ID NO: 7876 - DNA, 182 bp, Bacillus thuringiensis
  unsure (1)...(182): unsure at all n locations
gcggggacacaaacacagaacccacagnttangcaccccagaaaacaggcaacaaggggcacaaaaaagggcagggcccggccagccccaccaaaaccgacaccagacgcgaacacgaaacccaacgaaggggaagggacaacacgcaccaccacacgaaaaacagcaccagccacagacca

SEQ ID NO: 7877 - DNA, 431 bp, Bacillus thuringiensis
ccaaaaggaagtgccgacccaaataagccaagcacccgcacagcacacaatcccttacacgcagctaacacaaccaataaaacacctaaaagcagcgaaaaaataaaaaacgttaacaacaaaccacacatcgaacatcccctcccgaatagagcaaaataatgacgagcccagcgagcaaaaccgccgcaccagaaacccacactcatacaaacccgactaaaaactaccaaccaagaatacatgtgcctttaacaacacttccaacaaaaactgcaattccttcgactacacacacttcaaaaaagccaagcacaagaaccaatccttcccaaaaaggaacaccgtaaccgtcaacaatacatccacaacaaatttgtctctcaaaaaataaaaaaagaatgctccccacccccacccaaacactaaaa

SEQ ID NO: 7878 - DNA, 426 bp, Bacillus thuringiensis
ctaccactgctacaaagaatacttgcgctggcttatgaaagctatccacgacatctgatagggggcgatccatcatcttcgggggttccaaaacatcactcaaccaatcatattcctcggactaaccgaacagattgaccagctgcttcgctactctataacacaatgtatatgataatgacatctgcacaaactctatagctagtttattgatatctaccttctcataaaacaccgcaacactctgtgctgccatactatgtttcggattgaactttcaagagatttcatataaatcagttatcatagtgaccatagaaacctgccacacccgaatgaactactactgacaaactctcgaatgataagactgtacaggtgcaaattcttctgaacagagtcctttttgcgttccggaccctataa

SEQ ID NO: 7879 - DNA, 263 bp, Bacillus thuringiensis
ttttcattatataaaactttatttcgtggggacgagggggacctaagaaaaaaacagggcctgctcctcctgttgattgggttgctactgcgccccgtcatatacgccactagccttatctttgtaggttctacccccttaaaggtcaccctatcttcacccacgcaattacatcgcacttactctgcccataacagccgagttctcacctatcccacgcatggaccgagtgggtggctggaactcacttagtgccagatcca

SEQ ID NO: 7880 - DNA, 281 bp, Bacillus thuringiensis
cgctctctgtattattagttaaacacaatttaactccttgtcaaattgtaatcgggatggaaggattacataatgaaaagtcgctagaagaatactctgagaattatttagccctatggatactaagaaaatggaatgaaatacataatggatttgaatttcaaatttcttgcaagtcccggtcattctcttctttgcaacagtttgccaattcgcattgttatgttttaaagcgagtttcacagaattcgaatttggcattgaaagatatttgtgttatt

SEQ ID NO: 7881 - DNA, 197 bp, Bacillus thuringiensis
tattctacggttcttctgtatataccccaaactctgatttggtggcatattttttaaatccgagggataccgtaacggataggctacctcttcaactacacatgatatagaatggggaattattacagggaactcttggatttgtaacaacagtatacttacaaagtattagaagatttacgaatatgttagtgcat

SEQ ID NO: 7882 - DNA, 306 bp, Bacillus thuringiensis
atatataagagcgcctttgtttcaagggttacacactgggacggggaattttcatcaggcactcgaagctatacgacaacaggcggtgcaacaaacacacattcattcacctcaacaagggccatctttctcgacacgtacggtacagggaacacgttaaattgaaagacaacctgtgtcaagccgcagagcaagacttacagggagtacaacaaccactgtgatcaaccacatacggaaatggaggagccgcttatactacactgtaacaagcggcgtatggctcaatacaggccaaatattaca

SEQ ID NO: 7883 - DNA, 384 bp, Bacillus thuringiensis
gaattgtttttatgccgttaggagctgacgtgacgaccgcatgctaaaaaggacttagcgcgctggatccggcatgcaaaggtgtgagggatcttacttatatttagaagaggtggatgttcgcagtgaacttgacaagtgacattggcctggcgacagatgtggaactaacttgtttgagacagactatgaacattatggggatgaagaactgagcctgctcgatacgtttgtatagatgatcggtgaatagaatatgtagctcattgtgaataccgacagtatgtatactgcaagggtggcagtatacattgatgacagtacgacttgatgagaccgaaggttgattgctgatagcgttcactccaatttatatgccttaaa

SEQ ID NO: 7884 - DNA, 177 bp, Bacillus thuringiensis
ccacatggagctgataccactaggaaggttttttaacttggacatttgatgttgctgggacaacagaccctataggatgccacgaaccgactgtttctcaagcgccgttaattcatttccctgcatgttagtgcacaccacacccgctactaactcagacggcccagactcgagctt

SEQ ID NO: 7885 - DNA, 354 bp, Bacillus thuringiensis
acgcctaatttttgtttagatcgagcagtcgctgtactggggccagttgacgaaggaggggcgtaataatatgagttgaaggggggtatacgagaccattatgaaccagatgtgaactagatgactaaaatgtggcctaaacatagcttatttaaaacgtggtgcaattgcgcatagctcgtttggcggaacagtaagaccgtgatgtactttcgtaggaatcatatgtgcaagctctggaaacctcttatgacggactgcagtatgactgaacggttcttaagctagaacaagaaaatgtagacgctcatatttatcttgtgacgagtataataaatgaggatttagaagcga

SEQ ID NO: 7886 - DNA, 344 bp, Bacillus thuringiensis
cgggaaagcctggcccccaattccaattttggaaaaaccctttattaaaaccccttcaaaaggaaggaggggttggttttaataataaaaaaggggggatgccaattgttccataaagtaacttttacccatagaaggctctgaaaattggtttttgagtttgaatcaaggggaaaaaatggcttccccacccaaaaaaatgccatgtggggccaccctataaaaaagtttaaaaactttggggaagggctaaagaggggtgtctattttataaaaagggaattccacattttggggcccccatggtatagggcccagaccccccggggagtaaatagggcccc

SEQ ID NO: 7887 - DNA, 107 bp, Bacillus thuringiensis
ccagaatgagggatccacaggacttagttgaaattaagatcggttttttttttccccctgccctcgcggaaaagggggcttgtacgttatgcgctcatagataaccg

SEQ ID NO: 7888 - DNA, 357 bp, Bacillus thuringiensis
  unsure (1)...(357): unsure at all n locations
cgagggtcgcgatagcaaatactcatttactctgtacaagtcatttttttcatgggcgccgaatgccacaacaagggggactcttctatgtaacgggcgcaatggcattgccgaccaaatcaggtaaacaacaagctagttcttaagcttctaaacaagtgggttcatgtgtaggcttgtatgcagctgcctaaacgaaccacctgcacggtgacgcttacgtatttggaatctatcacgctccaaaacttaaatgnggatataaagagctacctttcagaattcaatcgacgaccacctgtttcagtagacaggtcttacagaacaattgcatttggttaccaatgagccaacctc

SEQ ID NO: 7889 - DNA, 174 bp, Bacillus thuringiensis
cttggggtagcaaagatcatcgtgcctgccaaatctaaagcaagcagcagattggatcactcgttcaaataatgacaattgtatttttaccatacattaaagagcatcctccgttatgtcaattccccgcttccgccctcgaagaatcataacaaatacaccgaacacgatgac

SEQ ID NO: 7890 - DNA, 293 bp, Bacillus thuringiensis
  unsure (1)...(293): unsure at all n locations
tatatgaacccaaaatcaaacacggccacagaaagggcgnggacgtagaattaaaagacaccgcggatcctaaacccacgagaaaacccaccaactgaatgaaccacgggttaccgaagtcgaccaacgaacggagaataccaacctagcacgagtagagaagaaaaagcttgagaaaaacgaaaagaaaccagcacaagagggaccgccccggaaggtctacacacgaaaagaagagggcccccaagagcctgaatagacccggaaaaaatgggaacaagcatcgccaaaaa

SEQ ID NO: 7891 - DNA, 398 bp, Bacillus thuringiensis
atagcgaattttttgctactagcgtataaacagaaataggaggtatttttgaataacgtgctgcattacctcccggagacagataaacaggcggtcatgcacgtactatgactaccttcgtagaaatgttagacgaccgcatatcaatactagatgcgttgactcctggcttaacgacaacggcatagcaagcttgcacatacacctcaccatctgtgggggataacagatacggagcatcacgacaggaacgtagtgtattcttagcgcttcatgacctgagatttattatggctggtcacgaaaccgatcttccagcggattaagtagaaggatcatacattatgttgatagttgggataatataatgaaactttctatggcctatcacgactact

SEQ ID NO: 7892 - DNA, 131 bp, Bacillus thuringiensis
aacctgcgaactgtgtccctagctttcatgtcattactacatccggtataatggtaggttgctctaagccaagagaacagcttgctattgaattatccaaccttgctagcactacgccacttattattaga

SEQ ID NO: 7893 - DNA, 264 bp, Bacillus thuringiensis
ttttaaaaagaccactttttacatacttataaacagcttaattgtatcgacagtctgtatgatcggacaacctatcgaatcaagtttagcagctcatgcttctgttttccttcagcataaagggagaaactcaaatatcttcctgtttatatcaacgatgctgattcctagggaagcaacgatggggcctaactttttaacgacaaaaaactctgggaaggaacaatagattcgccgggatagacagtgccgctaattgcaaca

SEQ ID NO: 7894 - DNA, 357 bp, Bacillus thuringiensis
actctgtgtgtaaagctaatgtatactactcgtttaccttgcacatgatacataccacctggggggaacactaaatcgcccaggtaagaaagctatgatgctactaaataacgtcctggcacacctaataaaagaggcactgcggcgtctttctttcctttcacttgaacgtgcatgctggcaacctctatatctaatatagttactactgcttctgcctgtttgtcacgcccatacctcatacctgaaacgataatatacctctgtatcagtttcaaactcaatacctataaaaacattgcttgcataacccacaccatcaaaatctggctttaacacatattcaagtgttcgcac

SEQ ID NO: 7895 - DNA, 229 bp, Bacillus thuringiensis
  unsure (1)...(229): unsure at all n locations
gaacagccccagaacgcgaganncaagaaagagcggaacaagaaccgaaacatactncaaacgngcacgaaaaggcggaaggcagaaagtaacgacgccgaagcgagaacagaagacaaaacgcaaacgatcgtgcgtaatagccccaagaggatcccaagaaaaagaggcaacacaacgagcgaaaggtaaccctggagggggcgccaccaattctaccaaacagaga

SEQ ID NO: 7896 - DNA, 141 bp, Bacillus thuringiensis
atgctagttctggcgcattaggatgcttgcggttcctactaagcacactacttcttcaaacggggggttctcttttaaatcatcagctcctatacccaacataagttaatggatcatcaataatcgagctcacagatgatg

SEQ ID NO: 7897 - DNA, 362 bp, Bacillus thuringiensis
gcttggatatgccgtaaatccccattattgtgtttacttcacataaatactcacctcatttcgattagcgtgaacctgtacaacaacaacggcattggcatgaccaatcctaatacgcttaacctgtagacacgctacccaacgcatacgttcatgcagccttgaacaccactgctgtgcagctgatgacactgcaatacaggaacccacatcagcatgcgagagcatagtgacaggtgctaggccaagctgatgcaaacagcgtactgatgacacactaagatgctgcccctcggtttcaatctgtatacagacatttattaactaaccctatgcttgacccaatacctgaatcgacattc

SEQ ID NO: 7898 - DNA, 233 bp, Bacillus thuringiensis
caaaacgatcctctatattgccaacacactcacaagctctggggggaatggaaatgctacgggcgtaaaaaccagccctccaggctgttggcgacatcgcgctaactcaaaaagatcaaaagccaccggacagaccataaaatcttgcaccaacaacattaacactaccatgaacgctaataccggcacaagctattaccgtctagaagacccttcctctttacccttaccat

SEQ ID NO: 7899 - DNA, 307 bp, Bacillus thuringiensis
tgggctcgagacgcttggccacaaactcatatccccaattgtgtgcgcgctcggtgaaagcaagaaaggggggttagtcaaagaaatggcggaaattcaatcgcaacaaacaggagaagggaagcgcgctattactgttgtccgaattaggtcttaagatactgaagatatgatcgattatgggcctaaagggttggggcccttacctcgattgggtggatctacaaaccagtcattttctttatccaagaacatgtacctcctattcgaacacggatacgcatagctggtaaagatcctggaagat

SEQ ID NO: 7900 - DNA, 247 bp, Bacillus thuringiensis
cctgacttatatttactagcagataacatacttttaggggggactgacgcatggacagttgaaatatataacggcgaccgatgatatagaacctaaaatagaacccatattatttgaccaaaatgaaaaatactcatctgaaaaggacaactttcaatcccaagatgctatagcgctcattgcaacagtgatggctgataaaaccaggctacaatacaacgaagacccaatatcaggagaggcgatc

SEQ ID NO: 7901 - DNA, 430 bp, Bacillus thuringiensis
ttagcgtttattttatcacatgtggcggaccccctgccaaagggattggtccagtgaggatcttgattatatggagggcatgacagttcatttcagcaaactgggcacgccccttttgctgagcatgtgaaaattgcctaactgggcaaacgacagggagcctaatactggaataaccgaaagttcgcacactgatgctaacagttgaatatgctggggcctacactgatgcatcaacagatggaacatgtcacttactctaggtgactatgtgaatctgttgttggacagcgcagatgatgagagatctgcacttgcaaaagaattgaatgaatggttaacgcctgaggtaggggctattgcacttaatgaaccaactgttttagtacacgatactgactaggcagttctataccaactaccagaggac

SEQ ID NO: 7902 - DNA, 298 bp, Bacillus thuringiensis
  unsure (1)...(298): unsure at all n locations
gccattaatttagaaaccaccgntttaaacacgcncgaagaacananacaacaggaanctatcagggacatgcccaagatcaccctgcgataagaaattatgatacgtatcgaccatcaagaaggagcgcaaaaaataatagcgcaaaggcacgggtaaataccgcatcttcgtcaaccgaatgaaatccatacaataaatgcaagtcactgctgctctcaaaccatagattctgtcattgtgtgagagaaaggaagtccgtatagacgagaaggcaaaacgacgggcaaacaagcaa

SEQ ID NO: 7903 - DNA, 210 bp, Bacillus thuringiensis
attttgttatataaacacttcacgtaactcagattaaatacctacgtgtgcacatagaacatcacatattgccttaataaaatgtggcaccgacctgacgccctacgcatcaatcgctcttgccataactctcaagggctcttgtccgctttggattaaaggctattctgccaaacccttattgggaggcattggatttttactactccc

SEQ ID NO: 7904 - DNA, 100 bp, Bacillus thuringiensis
cacacgcgtatcgatcggatccacgaagtgcgtgattacaaacaaacacattacaagaagcgcatgaaaaattgatttcttcaaaaacagcaaaaccatc

SEQ ID NO: 7905 - DNA, 158 bp, Bacillus thuringiensis
tatgctctattttttcacataaaaatttatatagtaatgcgaaggatttattcaacttattcactcgataccaaccatgaccgcgttgttacagcacttcctatattccatgtattatgcttaacatttgcggtaaatccacccattgctaactgtcc

SEQ ID NO: 7906 - DNA, 251 bp, Bacillus thuringiensis
cactaaacagccaaccacccctaggacggttttaaatccgattgggggttcaacacctagcgcaaccctcaatgccacaaattcaccccattcccaacactagctcctccatttcgaactttccattcaccacaagtaataccattatcacacccactagcaaaagcttctccaggacctaatagagccgacccaccccaatcaatcttcaccaccacagagcaacactctgttccccttgcaccagctat

SEQ ID NO: 7907 - DNA, 188 bp, Bacillus thuringiensis
ttttttaacctaccgtgtctatccttttaagaattatgggtatcctttttggaatcggtgaaataaggaggccgcaaaagccgaaggcatgggttaatttccacggtccggcctgtattttataggtgggggtacaaaatatatttccacacaagaagagactataccctctttttgcacaataaaaa

SEQ ID NO: 7908 - DNA, 240 bp, Bacillus thuringiensis
gatttataatgttctttccgttcgctaaataaacaaggctgggtttatgtgtatgaccacatactatcatcctttgttctatattttgaagatgatccattatatttttttcattctgaaacccggcaggactctcatttatctattctaacaaatacacttgatctgtagttggcgtaccgggtcagcatatcatattgaccgcattcctgtgcgactgttttcgttttaaccacgcga

SEQ ID NO: 7909 - DNA, 389 bp, Bacillus thuringiensis
tgataaactagcaccttttttatttcgcccctcttttatgttactcgcatggtagcaaaaaaagggggggttttttaaaaaatgggttggattccaaaatcaagcatccttactgctacagcaccccttggagtgaaaagtttgacgaatacttatcctgctgtgcctgatttcacatgacaactgttttttttcagagagaggtatacctttacccctttacactctaaactgttaattatgcactcaggcgatacccccatatttctctacatgcggacaacaattaacggctccagaaaacccaactcaatttgtggaaaagctacttgataacaaataccggacgcgcttacctacatccccatttcaaaggcttttagaaaaat

SEQ ID NO: 7910 - DNA, 533 bp, Bacillus thuringiensis
ccccggttgtttggagttccctgcccccggcggggctggcccccattcccatttacctttggggtttaatttcatggggtttaggtttttgccaggggagattttaaccccgggggggggggaccccttttggtttgggggggtttaaaaataaaggggtggtttccctttgggcctccccccttttttttttcctttttggacccccttgggttttttgggccctaaggtaagttttggaattcccttgggggcctttttttttttcccccgggggcccttttggttaattcccttaaaccggcccggccccggccccgaaccccttttttcttttcccataggggtttttttaaccggggcccccttctttttttttggcccgggttttcccccaattttggggttcttttttccccaaagggcttttcctcctcgggaatccccatcacccgtttttttaagcccttttacctttttttaggggaaaaaaaccggccctttttttttcaagggccttttttcggtttttt

SEQ ID NO: 7911 - DNA, 115 bp, Bacillus thuringiensis
  unsure (1)...(115): unsure at all n locations
caaccaggacgcnggccaaaaaccagccaccataaacagagngcgcaacagcncacaagacgagggacgcagcgccgaaaaaggaccggggcaaaaaacaccaccgaagcagcgg

SEQ ID NO: 7912 - DNA, 324 bp, Bacillus thuringiensis
attggtgatatgccatagctgcatcgtatgatgtaatgttattattatttcaaatggattttgtgttgggggattatgggatgatgagatggacgcgcgcatactcccaatcatgatcattacaattcctgtttcggtgagggtgaagtggaacgactttttatcagttgacagaagcgaaagttcctagctccttgtcgtttataatactcgcgaaaagcgccgtcttctactctgggagaagcgaacgtattacgcccatactgtgcgaagagcgtattgattcgcgcatactacacgtgtgatgacgcatgggcgccatct

SEQ ID NO: 7913 - DNA, 275 bp, Bacillus thuringiensis
  unsure (1)...(275): unsure at all n locations
gccttaaatttagaacacaaggatttaatcccgaaaaggaagaagagcagggcgggattttatggggggaagacgcccaaacgccagccgagaagacgcaaaacgcncaaacaccggnagcgcacaaagggaaaaccagcgagcaaaaccgcgaccaaaagaanggcnagaccagccgaaagaacacccaaaaagcggcagcggccgggggacaccagcaaaaggaaaaaaacccgacaacaaggcaaaaaaaacaaaaagagcaccgggaaagg

SEQ ID NO: 7914 - DNA, 129 bp, Bacillus thuringiensis
  unsure (1)...(129): unsure at all n locations
tttaccaaaaacgctttttaatgaaaaacnaaaacgttgnaganagaanccaacganngnggaagatgaccttctttatggttggacgccgttttctacctaaaaaagaagacattactgccttaaatg

SEQ ID NO: 7915 - DNA, 443 bp, Bacillus thuringiensis
tcatacagatactgccaggcatattgtcttgcttgctggtcatcttgaacgtctactcttaatgaggctaacgaagatacgcccaccagtcaatgcttccctgacagagcattaggacgcgacacttctgcccgcttcatccagtgctggttttagtagaagtagcggctgttcatttcctatggacaccgatggaatatatgattgatttgtaaactatatgcctatgtgtaccggcactcattctttaaccgaaatagccgatggcgtacctagcgcctatcaatactcgtggattggaaattggagagactcatatatgcccttggccttatgacgcgatgcacattatgtggcacacgaggaattaaacagttcattactcgccagctgtcccttacataacgagtgggtaagggactagctcattctagcttgctaca

SEQ ID NO: 7916 - DNA, 140 bp, Bacillus thuringiensis
gatcggatccgaagtcggatctggctacgacccaggtcacttctcagttcatccgcacttgaggaggtccctccggagggggagaccctgacaccctcggtgattcaagaggctccggctggcacctaaccggacctgcc

SEQ ID NO: 7917 - DNA, 155 bp, Bacillus thuringiensis
aaaaatatgacgattggaaattaaacggcgacatttttattctggcacccagtacaacaaacagggggggaattaaaaacaatgggaattcgtaaagaaagtaaatcaccagaagagcagataaccaaaaactggagaaagaatatcaaacgaga

SEQ ID NO: 7918 - DNA, 467 bp, Bacillus thuringiensis
ccgggccggggaaagccttgcccccaatcccaaattaaaagggggtttccctccccgaaaaaaacccccccttttgggatggggccattttatccaggggggcccaaatttccccaaaaattcctttttggccaaaaccaaccctttcctttaaaaaagggagaattcccgggggaaatttttttttttttttaaaccgcccaattttatttccccttttgggggggtttttttaatttataaaaaaggtccccaaaaaggggttttccctttttccccaaatatacatttgcctttggcccttgccggggccctaaaatttggaaaaaaggggaaaaaggggaaagttttttgcccctttttaagaagaattaaaaaatggttttttaagaaaaaccaaagggtggaagccccttttttaaaatctggccaaaaaattttcaattccttttgggggaaaaaaaaac

SEQ ID NO: 7919 - DNA, 420 bp, Bacillus thuringiensis
tgaccgttgtttccaacatattgcaaaaaaagcaaggtgggattaatggcctgggggggggactccgctatggctcttaactcatacggaagcccatgggtgtcatcgtaaaggccaaaatgtatcaatggccaggcgcctggggtatactcctgccgatacacacctgcgttaatacatacatgttcattggatagcggaagtgggcagcaagactaatagtatgatcaataaactcgacgaaacattgtgtggcgcataagacttttattattcgaaggaggcataccataccattataaaactcatgtcacatcgaattaaggaccatattttctatgcaactaattgaacaaagttctaagttagatacattcaataactaactaacggagaaaactgtaacgagaggtgagagcg

SEQ ID NO: 7920 - DNA, 328 bp, Bacillus thuringiensis
  unsure (1)...(328): unsure at all n locations
ggaacatttaagacagggggcccgcaagaaggaccaacaacgccccgaggcgcgaacaggaaccccaaagaaacggacaggacatgcgagaccacncgacaaaaaaccgcggaaggcaaaagccaagccgaagaccaacaccgcnccgacgacgaaagagagaccgccggaagcgggcactccagnaaaagaggaagggcggcacaggcaagacgacaaccgcgggaacagagaaagcctttcagcgttgaactgaatctggagaagactcaaatggtcaaagaccccaaaggagaataacttcgagctttaggaaactgacctgtga

SEQ ID NO: 7921 - DNA, 192 bp, Bacillus thuringiensis
ataagcccgggaatgcgagatgccgtgggcctcaagacgaaggacacgcgcgtaatcgccctacccgggacaaatacccgggggcccctgcgcggggcacagctgacggcaaataaatccgtacaaacgcccctgggcggagatctcgcggagaaaaacggaaaagtgggtggagaacaacgtcaccgctga

SEQ ID NO: 7922 - DNA, 390 bp, Bacillus thuringiensis
atatcaacagcataaaggctaaagggaccaccgagtgaaaatagggggtattaataaaaaacaggcactcctcacggaccgacaattgaacctggatcatggacttgcagttgttcaccagagacagttcccccgagcgaaccatacactgcgagacacaaactgtatgccattacattttgggtaatcgcgcgctttcccatcagtccgtatctggacagctagaactgtgccatccactacaccagacccgctaactcctgcactgagtcttttcacaaggccagtaactgttccgtaaccggaacatacagaccgcacacatccaacattgccgtgcacagctgcttttccgaggaactgcaccacatgaaactcgccaccatatta

SEQ ID NO: 7923 - DNA, 302 bp, Bacillus thuringiensis
cccccactcgtttggtctaaagcgcgcggaggctcaacaagcctaccaactcatacatataacagattctcttatacttcaccaactactaatataggaggtttttcataaaaataagcgtagccaaacaacataaatgaacgcttattagcttaaaaccaatttcacttatccgcatcttctacttcatatctatctttaaatacaaccatgtcttccataacatattcaaatgaacaccgttataaaccaacagacaatctcttcacacatcaaactctctaaaaacataccaacgtcaa

SEQ ID NO: 7924 - DNA, 146 bp, Bacillus thuringiensis
caccacctccacacactttactttcttaccctcccacccccaaacttccccggggtcctttaaacccccacgggcgttctaacaaactcccccccttttaaattgtaaccttcttattcttcacaaatcctaatatctcaagagac

SEQ ID NO: 7925 - DNA, 125 bp, Bacillus thuringiensis
ggcaggtcctttgtggtgccagccggagccacctggatgagcgagggtgtcggggtctcgcgctccggagcgacctcctcaagtgccggcagcactcgagaagtgacctcggcgtcgtagaccag

SEQ ID NO: 7926 - DNA, 455 bp, Bacillus thuringiensis
ggtgcgtgatttctttccaaaaaacccaagtactaaaccttttttatccccctctcactcaattataaagggtggattttttaaaaacaattggggctaaaaaacaatccacgaaataagccaattaagaattaaccactatctaccactatgatttataatactactcgatatgcccaactcacactatctactatcatactctaaccatcgtgaatacctatcacagagcaaacaaatttcaaactaaatatacacaaaaccaatccaaaaaacactactcctaacaccacctgatgtaatcaaccgcatgctaagaacctaacttctctgagtactaataaaccaaccagctccctatctcctctagctcacctataaccctatattctttcccatcaaataaaaatattaaatagagcgcctagatttctacaatacccacccacatcact

SEQ ID NO: 7927 - DNA, 298 bp, Bacillus thuringiensis
aaataaatattctgggacacaccaaccctgttaggagtggacaattatggagaaacaagggaaacacccttcaaaaatacaactgactgcatcaccaattccctccaaccgaagtttcatgtaattggatagagaagatcggaatagagagcagtatttagagcattatccaaagttgaaatgcacacatagtaagactgataacgttgaaatcacgacgtaataagaactggtaccaccatcggtgatccatcttcatcccatttataccaggcctaatacatcagagtaatacact

SEQ ID NO: 7928 - DNA, 396 bp, Bacillus thuringiensis
gtcatatgcgatcgtatttcaccaacgagacgacaggtatcgtcgttactgcgctgctatttcccggtttcctaacttcactgacatcgctgcatctgaatcgtcatttttgcttgccgcggtatgagtacactgaatggcagacgtacggacatgcaccctatcccctaaagcttcaaccatgaacagaatgaccagtatgccactgattgggctggaacttatacatcggtcgcgatacaggtggttgtctatacctccaacctactgcttgcatcgaagccgttgattgttcagtgcctggagacaaatctgcacgtgactctgatgcacccagcccttgtcacgtggatgctcccgagtgcgctctaatgtgctgaccctgacgattaccgt

SEQ ID NO: 7929 - DNA, 186 bp, Bacillus thuringiensis
cgagggcgtgatattcactttaaatcatccctttcaaagacaatcttgtactgaaaaaagtggcaatacattcgggggactaatacaaatgctcggggcgccaaaaccaggaaaaataacttcttgtgtttggatgccatccccccgaagtatcaatgtctcgataaaactcttacaaagaactcc

SEQ ID NO: 7930 - DNA, 122 bp, Bacillus thuringiensis
agaacccaaaccctcctttctgtatattgaacctacaaccgggagacgtttaaaccatctggggggggaaaccccccacaatagtactgatgaatcacttgcaggttacttgtgatgaaatt

SEQ ID NO: 7931 - DNA, 351 bp, Bacillus thuringiensis
cgtgcgtggcatctatctgctgcgtctcatcatttgctaagttttttccgcgacagatactttcgtctgcaggggcggatatggtaagaggggcatgtgcaagatacctgttcagcatatccctttcaagatgcaccgcttatccatagcgccgttcatcaacgatatacttactagttatcgtgtcacgcgctcggaatgttacagagataacatagcttactatgctcaacctgtttattctacgccatttagtatggtgcgctcctaagtgccagctcgcacaggcaagactgtcgatcatcgtgatgatctcgatcacggactagctcattttgcaacgccacatac

SEQ ID NO: 7932 - DNA, 213 bp, Bacillus thuringiensis
atatcaaggattccttgcaaaagagtcacactatttttatcctctattctttgctagatcaatggaaaggtgaagacaggaaaggaatatcaaattcatcacgatgcatacaattccagaaaaattttacaagcgcccctattccacactgcgatacgctcacctactgcataaaacttgcacagaacattatggcgatattcgagactaaag

SEQ ID NO: 7933 - DNA, 200 bp, Bacillus thuringiensis
cgtgattgttggaaattccgtggtgcaacgacacaaatttttctataatgaccgcgtgtcatgatgcgggggcccattatatgtccagtggcggaaatgactctggatacgcaggaacgagttaccagcattaacccagacgaaaaacttatcattacagaaaagacgcatactcttacatacgacacggctcattatcg

SEQ ID NO: 7934 - DNA, 217 bp, Bacillus thuringiensis
gctgggtatgccaacaggcttctcctggagggtttatctacagcgatacctaattccgttcgaatggggcgcacgtatacacctttggtgttgccatcacatgaactaccactcatggaatccagtgtacaatccaatcaattgatgcaaatgctcgaggctcgttgtaaaagcattgcaccaggcgcaacaacaatttctcgtgctaccttaatca

SEQ ID NO: 7935 - DNA, 184 bp, Bacillus thuringiensis
aattcgagatcatgggggacatgtagagcgcgacaaacttttatcaagaaccgctgaagacgaccacgggggggtcgttgcaatacgtgcactagctctggaaccggcagcagcttaagcagtgctagtaggacacttacttcatcatgatgcatatatagcgaccggtgttgaaaagaccgat

SEQ ID NO: 7936 - DNA, 246 bp, Bacillus thuringiensis
cccgctgcacgagatgctcgacgactatagaacagccacaaccattgtgtgataccctagtacttcaccttttggtgagcgaaatcgcaaaccattacgctgcattggacccagtacatgacgctatgacaggttgaatgtgaccactcaggcctgaaagtgagaacgtatcaaaccatggaggaagtgatagtgagactatgcttactgcaggaaaaggttttaagctcactaacgcacacattg

SEQ ID NO: 7937 - DNA, 194 bp, Bacillus thuringiensis
gccgcgtaagccaaaacacttcccctgaagagccttttgtctgcgaaaacaaagaccgacccaaaaggggggaattataaaaataacgagttggcctcacatgacctactatgcatgaaatccaatgtccaatccaagctactcaataaatgaccgaagccactgcttcaaacaccgtacatacgagccacaca

SEQ ID NO: 7938 - DNA, 349 bp, Bacillus thuringiensis
ctggcaacccttttttcgctcaccaggcctgcaacgcccgtttgtcaactagtcgggctaataagctacaggggacccatctcgtactgccttctaagccgactgacatttaacggactcgaaacgctcgaggaacaccgcaggctggacaattattacaatattaactggcggcgcgagcggttttttccttgtcacattactacgcgggtatgaacctgagtgaattggaccgcctcaagtccttctacctacagaagctcacttatttaacagctttccaaacgctctcttcctctcgcgtgactaacaatagtctgctctcacataatactcacagccacccaac

SEQ ID NO: 7939 - DNA, 162 bp, Bacillus thuringiensis
aagctggtcgacgactaaagcagagtcgctaggatacacatcgaagctatgaagagcatgttggggggaggttgagttatataaccacaaacagaatctggcgttggcgcacattatcattgtcttggaacgattaaagaaaaagaaaaacttggcacctac

SEQ ID NO: 7940 - DNA, 464 bp, Bacillus thuringiensis
cacatgcaatacaggtgttccataccactgatatattattatcactaacacctacaattgaatagggagcattacgagcacatttaatatttcgaattctacgtaatttacatatagaagacggcgtattaattgcaacatagattccaattaatgtattgaaaaacacgagcggataactaaatgactgttcgttcgtgacctaatacagatggtcgctgctttcttataatatatttttctgcatccgatatacactactacctactaacatgcataagggagtacatatgcttatgtgtagatacaatacctatgataatgataacactaacgcgtgcgctaatggagagtcgccatacatgtgccttactgactttcaaaatagctcacctattataaagtgacgctctgattcaaatcgaaaagctggcacttatagtaatccacatcaattggttaat

SEQ ID NO: 7941 - DNA, 177 bp, Bacillus thuringiensis
cccggcgctgtacgatgatcccggccttatttacttaaaggcggatgtggctactttgtggcgaacctttatggtattacgtgtgagatccaagcgctgtactactcggctcctctgaacttataatttatacttctctgccttgatgctgttcaatgcaggtaggcatgtgtgcct

SEQ ID NO: 7942 - DNA, 419 bp, Bacillus thuringiensis
gtcgcctccagacgtcgtgatcttgaactacgagtactacaaatccatgtaattttttcgggtgcacagctacatattgaaccggggacataatgtcttgtgccgatagataaccatcttcttgaatcacaccaaaaaagtatggattgtttcgctgataacgaaatattcaatgccaatcagcaatacatagatccatgcctcctgatatatccactcttgctgtataccgaagaacgagagactcttctttatacattaccttacagaaacacctattctcgtagcatctcgggacataatgtccacataccatattggctccagaaataccacgtcctcacgagtcatagcataaggatagataccagaccgtttcgcatcaatggggctgaaccttgttttcatcattgaagagc

SEQ ID NO: 7943 - DNA, 237 bp, Bacillus thuringiensis
gtgatgtatgttcggtttctttcgtctcaacgtgatttatcctgcatctgtgatgatattcatgcgctggtggcagtgataattcttgtaccgagttccgtccacgtacggctaaggacatatcatgacgcatctttaatggagccgtgcgcggatacacttattagtcggggcgattatgcgcatattggctgtcaatttacagcaggcgcagcaggtacggatggccgggagccg

SEQ ID NO: 7944 - DNA, 391 bp, Bacillus thuringiensis
gtgcgcggttgttggctagattctcttactacccgcataatttttacattttcacagctaagctttttaagcgaggtaaagaaaagtgtaaaggccttcaaattatcttcctcatgcaaaatcgaactacgctctcttattgtaagactcgttctggctaatatcgatatcattctcagcccagaaagccccatatttgaggctattataacacgtggctttctcttcatacgcttcctacgttcttatcccgttagttatttgatgaaaatacgtggtgtacacgaccaaaatgaatcaagaggcaggtctcactctgactatcccgtgttgctaccgcactgtaccaagcatacacgcgcgaatgtgtatgaacataattcctatataa

SEQ ID NO: 7945 - DNA, 441 bp, Bacillus thuringiensis
ccccccccggggtgcaaaaccacccccggggcggagagcctggcccccaattccatataataaaacccctttttatccgtttaccaccaaaataaaaattggggggtttttaatcggaaagggcggaaaataaacctaacccttctgtggaaaaaaccgcatggggaccgtttctttacctatcataaccaatggtttggtagggttgaagggcttttggaaacccttaaggcccaaggggcggtttttctcaacccccaattcttttaacccttttggaaggtttcccaccgttttcagagaaattgtcccggaattttccccggggccccgtaagccctttatcctgccaacccaatttgggcaaaatataaagggttttttacccagagaccccaaccttttttttgccataacgtgccaatcaattaaaatcgaaaa

SEQ ID NO: 7946 - DNA, 267 bp, Bacillus thuringiensis
acagagcagtaatagtggtcggcgaaattgaagcccaagatgggagatattaagcagcaagaaaagcatctacagagaaagacggaaaagctcatgcttaatgatctatcagtaagaaaggccaaatgagtatggacgaaaagcctaccaggttatataaagctaacataaccgggaccattcgaaataaaaaaaggtatggcaaaagcttgagcactactagtagaaaacgagcggctagaccaaggctcagtagaaactacaaaa

SEQ ID NO: 7947 - DNA, 102 bp, Bacillus thuringiensis
ctgctgaaaatatgaaatcatatatctcaaacagcattacgaaatcatgtgcagaaggtgttttttcaaaccttcaagatatggctcaagggctgattgatg

SEQ ID NO: 7948 - DNA, 107 bp, Bacillus thuringiensis
agttcttgttgctttcgcatgatatcgaccgtctcatccaccggaagagggccgttacgatactacatcttatgataatgctcgttacaacctggagatttgcccac

SEQ ID NO: 7949 - DNA, 238 bp, Bacillus thuringiensis
tcaacacactcaaagaataaatgtaaaaaacatgtactcgttatacaacagcggctgcaagtctccaacgggggggccttgtgatcaataatggcgctcgccaaaagagctcatagcagtacttgcacacagtttactaactttataggcaggcgaccgcgaatactttaccgtgctctataacacgcgcggatccaatactcgcatgtaatgcaagtaaatttgagggcgcgtgcaa

SEQ ID NO: 7950 - DNA, 135 bp, Bacillus thuringiensis
  unsure (1)...(135): unsure at all n locations
ttatagaagagaaacatgnnttataaaaantggnngaattgntagcggtggagtttactgtggtttagttatgttcgcagcaacgacggtaacccgganntaatatganccagcgcnnagtataccccgaaaatg

SEQ ID NO: 7951 - DNA, 158 bp, Bacillus thuringiensis
  unsure (1)...(158): unsure at all n locations
cgggncacacacgtcctggggggtgtttctaaggcacgcggccatgcacccggagccgccgggcaccattatcaccaccagtccattgagcgagcctaagaggcgcgccgacccggaatgcaacacgccggcccgacaggcgcaagcgcgcaaggaca

SEQ ID NO: 7952 - DNA, 372 bp, Bacillus thuringiensis
tatattcgaaagtcggtatacaacaagagccaagccatggggatgttattagattaggggcggttgcattaatactctgataaacaaggtatataactagaaatggcatgataagcacctgaaaagccattcataaaagctaaggcaacatcaagaactcaatgcactggattgatagattatacgctgtatactcaacattacgtatgaggaatatgaacgcacactgactcctacctcagatacactactatagaaagacagttagttggagacgaaccatctcaaaacaactgagggatgcggacactaattctatacgccagagcaagactatgtcgacactcataagagggtattctggggagagcc

SEQ ID NO: 7953 - DNA, 142 bp, Bacillus thuringiensis
tgcacgtcgtgagtgatccatcttcgaacaagttgctcgtcatactactttttttttcaacgacgactgcctacaactgatgggggccctttatacaacatacggcgccgctcataaaaactcaaaattgtgccgcacataa

SEQ ID NO: 7954 - DNA, 186 bp, Bacillus thuringiensis
tatatgcaaaacttaaagtaatataagcgatacctttcttcctcccccgatgcgaacttgtggtaggctattttgggaaataacagaccagttcaatttcgttatggaccggtgaatggagatttatgagttggagttgaataaattaaatgcgcaatggtttaaccggggagattatttctttta

SEQ ID NO: 7955 - DNA, 262 bp, Bacillus thuringiensis
cccccacacattggggaaaaccacgggggctcagaagcttgacactaatcatattgaagcgatatcaatcgaataaaaccctctttttcgcgggggctctttttaaaaaccagggggtttaatctaaccgccttcaatggaaataatcgtatcaacatgcggaatctgccctatacaatgtgcgactataaccgcgacgtccagtcaacaccattacgtcatgaaagcgcctcttggaatatacctccacattgcctaaata

SEQ ID NO: 7956 - DNA, 334 bp, Bacillus thuringiensis
gctcaagatctcgtcatcaattcagatactactgtgtttttgtcaaagttcactttattcgtaccaatggcgcctttaaaatccaaaccgggttttccatcttcgaacgcaccatctgcgctctcatgcaaccaattcgctcgttaccgttaagctgttgttgttttcttgcgaaattctatctccatccacagatcaatgcttcttgcacactaacagtcttaatcaccccgccataacccgctcctaaaccttcacattttggagttcttcaccaattcacaccccttttcttcacataaccctcataatcactaatcccccgcactaaaac

SEQ ID NO: 7957 - DNA, 227 bp, Bacillus thuringiensis
aatatggcgatatagtggaacatcaccacgtgcctcttcaccgggggtccacttaaattcaccaggggcagccaccaattttccaactaaacttaacccttgattgaatggtaccaaaaggcgcttccttttacaaaaattttgccacgagccatttaaacaaaacttttttaaaagaaaaagcaccagctttaacttcctgctctaaaataccgtaatcttctatt

SEQ ID NO: 7958 - DNA, 176 bp, Bacillus thuringiensis
gaattcgggattgcggcgtcatgttattgagtatgctgcttgttactcaattacatgtttatgcagaagaaaatcgatggacatggcctgttgaaggtcagataagtgattattttgggacaaggcatggaaaacactatggtattgatgcatttgcccctcttgttacccttgcg

SEQ ID NO: 7959 - DNA, 154 bp, Bacillus thuringiensis
ttcgtttggactctacttgagcaaccaagcgttttgcttttacacgaaaaaaaactttcacagggtttttttaaggaaaccgcccgtttctcctcttgtgaccatgaactaaaatctttttatatgtgttactacttgatctatcttttatcgt

SEQ ID NO: 7960 - DNA, 164 bp, Bacillus thuringiensis
cgtgatcttcaccatgcattataactctcgggagaactttttctagaaaaactgtcacgaacaaaagggggagtgtttttgatagaatcggcggttatcggagctcctggcacagaggcgcacctttcctaaatggaaggcgcgaagccaccgcgttattctag

SEQ ID NO: 7961 - DNA, 229 bp, Bacillus thuringiensis
agagcctcttctagatgcgaatactcgcttaggtataaattcagattctgatgaggacgaaaacaaccgaaaccagaaaatatcgcctcccagttcaatctcatgctcgattaaagaccaccgaccactgtaaagacaggaataaccaaacgaaatagaaaagagcacaggaccgccaaatgtccaggggcaatagactttggcagcctcccccaggcctagtacaccc

SEQ ID NO: 7962 - DNA, 454 bp, Bacillus thuringiensis
caaaactgaaatcttgcggcgctaatgctctatccttcttatgaatggctatatattccgcgaaagagccgacctaatattcacttggacgagcatatattgcatcgacgcctctaaaacgagacactagccacccaaccttgacgatgacgccggaacagtcattaccaaggataagaggcgtttgatattgcagacacatctttacatttccatcacgtattctaaagtcaattgctacaatactagctgcatgactttatgcgagcactcaatgtcgatgtatatcaggagtaggaacctctgtcatgcacatcgggacttctcacgccttatcaaagatgattgctaacagtacttataccttccagtcctaataaatgttgagcaagagattataaatagctaacacatgatatatcaatacacctgattaggtgcgcgtatcaatata

SEQ ID NO: 7963 - DNA, 122 bp, Bacillus thuringiensis
ccacagcttttgttttatctagctgatgaaagcttgataggtgtagggtacagcattgcctctgatgctcaggagtatctgtgaccaataaaaaatgggaaggaacccggggtgattaatgc

SEQ ID NO: 7964 - DNA, 299 bp, Bacillus thuringiensis
ctgactgacctttttgcactcacggagcctgtaacgcccgtttgacaactaaatgggccaacacgcttaatgagacccgtttcttattgcgttctaactccgattgacatctaactgactcgatgcgctcggagaacatgctggtgggaccattattaccataccaactggcggcgttaccggtattcaccttgtcacatgactacgcaggtatgagcatgagagcaaagggccacgacatggccatctaccgacagaagcccctgtagttcgtcgctttccaaaggctgcgcccttct

SEQ ID NO: 7965 - DNA, 230 bp, Bacillus thuringiensis
tcaggtttctacttcaaggacctaagctcaccggggggggacatttcgatccagatgggcttaccaacgatgcccgagcggtaaaaacaacacgccctgtgcacacagcctccgacgatccggactaggtacggacaacgtaaaaacagaacttaaaggaaaaacacctttcaatcaattcccacgctcaggaccaagacatcactattccacacaacgcacgtgccgga

SEQ ID NO: 7966 - DNA, 149 bp, Bacillus thuringiensis
ctcactgcccgattgttcagtcaagagagcacacctggccagctggaggaatgaatgggtcaccgcgcggtgtgtgccattgtgtataatgtgatcatacccgctttctcgctcactgacttacaaggctcatgcgttgaagtttaaac

SEQ ID NO: 7967 - DNA, 259 bp, Bacillus thuringiensis
actgagattttgtacctatatggacaatgttgtgtttgatcactcggtcctaacttatcgctgggagattcttagccagagctttatcatgcatcggatttggacctgacccatgtactgtttacgtggggataggaaccagctcataatctcttaataataaagctgcttcttgtaactgtggatcaattactctgcctgtacacaaccttatacacatcccgcatgggagtgtgacctgagtagaccaacaggctat

SEQ ID NO: 7968 - DNA, 309 bp, Bacillus thuringiensis
tgctgtcatctactggttaggcaggtgctccccaaactaggggggatatttctgagttcgaaaagaccatccccggattctcgaataagatgagcacctaaagaaagcattgtgcataccattcgacatggagccagagtaactgttagctctgcagaggaatgcgagaattcagatctccccaaaaacaagaaacgtggttctagatcccgtggcaggggataagtaccatggctctcgatctgcaccgagcgacggatgtctacttctaacggagccaatgaaacccgaacccaaaaccatttgcac

SEQ ID NO: 7969 - DNA, 300 bp, Bacillus thuringiensis
gaagctttttttgattttcaagcaatgatgaagcgaacagagaatatggtcgctcatgtggagacgtaagtactgggtccaataccaatgcagtttggcgtggctgaaatacatctggacccacactggacacacatggatatggtagaggcaccgaagccgttcgtgggagctgagttctggaatccgatgagagtgggaaaagcgcgaggactgagcggaagaacttaaggaaaaggtgaaagtgacactggaagtcggtcatattctgacggagattttcgaacataacgtagacga

SEQ ID NO: 7970 - DNA, 395 bp, Bacillus thuringiensis
ggcacgatcagttaatgcttccaaataagacctcgtgagccgaactaatacttatggataggccatttatgaaaacctagggtttggctcatcaggcacaaaaaggaatacaggttgatccataaaaaaacattaacaccgatcacctgttacaagtggataaaaacggaaagagcgcaaataaaaacgcactaaaatatgcacaggcgctgcagacttcgatcgtaataaactacctaaagaaacaccgcgactatagcaaaaaaaaataggaggaaacatcccatgaccaaacacataagacatacggcggtacaacaatatacttgagagcatagttccaatcacataactgctatagcagcaccttgaaagcgctctcatcacattgaaga

SEQ ID NO: 7971 - DNA, 176 bp, Bacillus thuringiensis
ctcatacgattaaaagaaggattcattcctacgctgtgaccgaaacaggactttgttggtaacaggggcgcaaaattatcagctattcgtattcgtgagcgaacctatcttgttgaacttcgtggttcatttgaagcacttcatctcgtatgtaaaccagaagggcaagatgcccg

SEQ ID NO: 7972 - DNA, 630 bp, Bacillus thuringiensis
actcaatattttttgtgccaactttacgatctttatctgcagttgtgaaaatagagtaagaagtaaaacgtgtttttgataggccgcttatatgtgtaggtaaagaaatgtagtcgttatcgcggaagaattccatcagttcaatatcctcaaattcttttcggtcaacttgtttgtttgtatagcggcgttgaagttgttttaaagattcattccaagaaattgcttttgtgtcgtataccattgttctatctccttactgtatgtaattactaagaacatacgttctaatctagtatactctttttattagaaaagggaaagcaaaaaataatgtgagcttggatttccaagcttacatcattgatgcctgcgtcataatctctatttttcattataagttagatatgaataagaaacaagatgagttttttaatgtttggagttttcaagattttgtttattataagggtactaaagtgtaagggaaagagaggttgggcatacgtaatttcactgcaagggccgttggctagcggaaaaccacatgggcccaaaggttagaaatgaagggtttcgggtttttttaaaatccctttcaattgttagaacgaaaaattgatttaattt

SEQ ID NO: 7973 - DNA, 364 bp, Bacillus thuringiensis
gattttatacgataccgacacgttacacgttctctttgtaccgtgggcataccaggtgctgcatccagaggtgcccgaactgtaccctggacatggggagatcacctggcttgagctgtacgaccacgttctacacgccctagtcagactctgtttagctgcggttccgcctgttcagctaaacctcgcaggtgatcgtaactggccggttcattctacagaaggcacgcgatcacccgtgaacgggctgtgactatttgtgggcacacggcctcaggatctctgtgactcgcattgcggagtgcttcgcacgtttcacttagggtactggctcactctcgtgcactagggagaacttatgctt

SEQ ID NO: 7974 - DNA, 172 bp, Bacillus thuringiensis
  unsure (1)...(172): unsure at all n locations
acctaggaagctttttcctagatcaagacgcncctttctaccaccaccagaacganacgccggaggggttcttggangcggcccagaancacccagcggaacggcagnaggaacacgagancgagacgcaaanccagggacaaccaccgccncnggccacggaacacccacc

SEQ ID NO: 7975 - DNA, 298 bp, Bacillus thuringiensis
  unsure (1)...(298): unsure at all n locations
cacgaaanaaacaagggagaaacttttgagaaacccggcgggcacacccccagaaaggaggaaagacnggaacagccgaaggaagaaaaacgcccgcccaaggcagcaaaacaacgcaagacgacgacgaaccaaaacaaggacacagagacagcgaaacaccccccggcacaaagaaaacgcggcacaggcgaaacaggaagaacaccggccaccaacggacccaccgaccaaaaaagccacccaaacggcgagcaaacaagacaagcgggaccaacagaagaacgaaccagagaag

SEQ ID NO: 7976 - DNA, 420 bp, Bacillus thuringiensis
gggatgaagttctcactgattaaagtttcactttataatatttttcttataaaaacgttttcaaaataatttttctattgaaatttaaacgtatgtttcatatgctgagaatggcggtttaaaaactgtgatttaagagaggtagattcctacatgtaaaaagaatcggggtgatagtatgttaaatatatatttaacagaccgaaacggaaaactacaagagattgaggaaatgcaaaaggggtgctggattaatgtacttcatccaacagaagaagaaattcaatatctagtacaaactttaaatgtagacttagatttcattaaagaccctttggatgatgaagaacgctttcgtattgaaaaggaagacaataatactttaattatcgtggatattccgacagttagacatgacga

SEQ ID NO: 7977 - DNA, 175 bp, Bacillus thuringiensis
ataggttttttaccgcacgaacaggtacatgaatgtcgttaatatttacatctatcgctaatagtacaagagcaattaaagcaatttcaattatgtgcataaatagctgatcgccatctttctggaattgttgcgaattattctgattggcatcatttggaatggcctcatcaag

SEQ ID NO: 7978 - DNA, 403 bp, Bacillus thuringiensis
ccagacggcgtgattgatcgacagaaccggaacgaacataggacatggtgttttatcatcagagcctatacacttctgggggagccgacatactttttacaggttcgttatgtaaaggcatcatagactgaatacgtggatctagcgtggctggcacattacgtaatgaagcagcagaggcaacgattggctcataatcataaaatttaatgaggaaaacacactcaaaattcgaggctgctaatgatgaccgatgctcggcttgacacaacgtgtagggacgaggcctgagtcacctgtttctcttgtgacaattaagcgaagatagacataagcgtttacattattaaggcgtgaatgtgaaactggtatttacattttttctaccgtgattggaatggtt

SEQ ID NO: 7979 - DNA, 220 bp, Bacillus thuringiensis
cttcccttataacccaaatctcatctgggctgcatcaggacatccaatcggtttgatctgcgggtaaaactggtctgcacatcatgcgcggcacggatatataatttagtgactatccttcaactgattgtaaactgttattccagcctggagtgggggacgagcgatggcggagcttctcttagcactcctagccttacataaaggggtgttcacatgg

SEQ ID NO: 7980 - DNA, 321 bp, Bacillus thuringiensis
gtgacatagcagtatccatattaaaacggccgtcattttgtttgcacgagttgcttcacctgcaaacagggtatgtgcagcactggctcttatttgactctctgcgagcttgatacatacatcgctgactctgtttcgagtacagcattcaagtgcgcaatccaacaacaaatgcttgagcctaggatggctgattgctcctgccgtggtgcacatgcgcccgcggtcgttggcatatattgcgttacctaagagatagaccaattccttgtcacatgcggaacggcgtacatactggcatatgtaggacaagtccatatg

SEQ ID NO: 7981 - DNA, 252 bp, Bacillus thuringiensis
  unsure (1)...(252): unsure at all n locations
cgcggaacgaaaaaaggcnangannncaagaagaaaaacccagacgaagcaaagaanacnncannaaancancaagaaaaagaaaaccccccacangngccagaagnngaaaaggaaagnaagaaaaacnaacaagagaagaaggaaacgaaagacgagccaaccnnaccaaaaccaaaagaaaccngggagaaacaaaaaaagnggccgaaggacaaaggaaagacgaaagaaaccgccccagccgaagaa

SEQ ID NO: 7982 - DNA, 157 bp, Bacillus thuringiensis
actaatcattggtgtattcataccaataattttaattttaacaccaccttgttctacaaaggggtatgcaagaagaaagcgctcaccatactccatataaacattaatctgctaacgccatatattcaaagtgctcatttgactttaccaatgaatc

SEQ ID NO: 7983 - DNA, 358 bp, Bacillus thuringiensis
acgtgtgttctagagctctcgccggctctcgagacttgtgtccacattcagatgcgtgatgtaaatgtatttgatcaaaatgacggatcgtcttctgtaacaatatctaatggagcggttgcttcaattaaactttgggatggtatatctcgcatgaagtctcctattgactatgctagtggtatcgggagaataggaatacgggaactaagctaagcctatagagagtcgaatgagagcttggggtgcacctggttcatagtgaggccgtgtatacacccattttgcagcgaaccatgtagctgcagagtgagcctggagcttatcctgttcccactccttttgcccgcacttttca

SEQ ID NO: 7984 - DNA, 290 bp, Bacillus thuringiensis
gatcactcgccccctgttatctgtcatcaggtcttgtaacgatcaccagggggacataataacccaatggatctgcaggtgatccgtctcaaatatcctcttaagcagcttgtcaattgactgactcttaccagctggagatcatgcagctggtgcatttaataccaatgtgacagccggcgaacccgtgtttaccattaacacttgactacacaaagaaccgcctgctcctattggagcagctcaagtcctggagctaacagaagcgccattacttgatgctgttatac

SEQ ID NO: 7985 - DNA, 251 bp, Bacillus thuringiensis
agaggcaggcgctactacgtgataactgtcttttctgtcacagggtaaaccttctgatgtcatggggacgttacgcatatactcacgaagtaaccgttcgataaattaattgagctagtgcatgtacatcagctaaagacggttcaacgtaagcatcagttttatggatacacgcttttttgccaataacagaacaggtaaggaaagcttacttatcaagttacactaggggagaaatcgttcaatactcc

SEQ ID NO: 7986 - DNA, 114 bp, Bacillus thuringiensis
cctatgttgcgaaaagcgctctaccggaactatttgtttattccccgatatatagccagacttattatgtcgtattgcgttcttagtgtgcctattacgaatagttatgctttt

SEQ ID NO: 7987 - DNA, 193 bp, Bacillus thuringiensis
acccaacctttttataaaccacaagaagagggggcaagggggggctatttgctacagattaccttcaaaacccggacaccacaattgaaacgtggctcaccacgaccgcccgacaaacgaaaaatcgaccctcacccggcacctcaaatgcttgtactcaaagtaccaatcacgccgtaacctatcaccagtt

SEQ ID NO: 7988 - DNA, 103 bp, Bacillus thuringiensis
tgagcgaacgtgcaactatcggcataaccggcatttttttgaaacgcgaaaccgtatgtgtcatgaggactggttgcacctactcacgaagaaaccgttggaa

SEQ ID NO: 7989 - DNA, 249 bp, Bacillus thuringiensis
ttatcgatcggaattgtatttacgggactttcttttgtttggtattgaaatatgaacaaagagacagaatgatgaaaaggatggcgtatgatacccctactgtttttactcagatgaattatggcttgaagctacagtctataaagattacgcaccttttggattcacaaggcttagcccatgcgctaaaccttccatataagtataacaagcccccaatcatttcaattgttgttcccatgccaaaaa

SEQ ID NO: 7990 - DNA, 175 bp, Bacillus thuringiensis
cgtgataaactgaaccacaacatcattacaagcaacaacaattggaacagcaaagcaatacgccacgggggaagcatgtggaaacccccacgctgccaccgacaaaacagcatcaaaagggagcccaggaacaaacagaagcaaacaaacgacccgcgccataaaaaaggcgagg

SEQ ID NO: 7991 - DNA, 118 bp, Bacillus thuringiensis
acacgacgtttttgtaagctataaaaagagggatcatgggggggctcttatcttctgttcgggttcaaaccccggataccactattgtggtgtggaagtaatccgactgctctaatta

SEQ ID NO: 7992 - DNA, 428 bp, Bacillus thuringiensis
gtgattgattcagaatctatatgttgagacagcacaattggagagagaaaatgtcacatttaactggtgcattatgttcagagatggtccagcaatcttccccgttggtaaaataaacaagcaaaagctggtgaactagaccaaggaacactgccaaagtcaattgcccctggacattttgcagtcctgtgctcatttctatttcatttggttattcctgtctttccaatactccatcgtctttaatcaagcataaaattaaactgggaagcaatattttctggtttctatttttttcatcctcatcagaatctaaatttatacctaagcaagtattcacatctagaagaaactcttctaaccatgttctaaactcttctaaccatgattatgattgtacattcttaggaaaaatgttttaaatgaac

SEQ ID NO: 7993 - DNA, 322 bp, Bacillus thuringiensis
cgagaaaacccaagccccccaaccaattcagaccccccctttatttaacaattaaaagcaccccacaagggggggatttaaaaacacgggggagcgaacccaccccacaaaaacccctcaccaaagtgaacacatcatcccaaacgaccccggcgcttcaaatggtgtttctagaaagacccaggggccacacacccaaaaaacattcgcagcgcattagcccgcaacaaaactaaccaaaaaacccccccccccctaaagggagaaaatatggaaccttcaatacaagcaacccaccccccccgggacccaactgttgaaa

SEQ ID NO: 7994 - DNA, 210 bp, Bacillus thuringiensis
ctgaagtgagcgagttagcgcctactggtttggacctgatttgcatttagtgtactacagatattatgattgatggcggggagcgtacagaaataatagtgatagctaaatgtccgtacaattacactggcctgtttgcagcatgcaaacagcttgttataactcctggccgtacccaacttaaatcgccttgctgcacatccccccttt

SEQ ID NO: 7995 - DNA, 102 bp, Bacillus thuringiensis
ccctgaggaccctctggacccgaagccaacatggatgctggaacaccttgtattccttgcgggccctgaagtcccctatggaccttcctgcacctatcgatc

SEQ ID NO: 7996 - DNA, 464 bp, Bacillus thuringiensis
  unsure (1)...(464): unsure at all n locations
gagcaagaggaaacagagaatgaaccaggcaactaaaccgcgcgaaaacccgccgcaccaggggacgaaagacacgccacgccgcaaaccccaaagcaagacggagcagagagaagcgcgaagacgggcgagaaaaggaacaagcccgncaagcggagcagcagcgagaacagcaacaaccggtcgaacaccaggggggcgcgcagaaaagaagtgcaacaccagaccgacaaaaaccgacccgacaagacggacaccaacagtaacaggaaggaggacaagaatagcacctgaaaaagaaacggtcacaggaggcggagaaactaaagaggaagcagggagcgacgagaaagcaaaactaggaggcgaaccagagaagcagagcgcgagaacaagcagcagcaggaccagtagcatagctgggacaccagaaacctgaggaggaaggaagcgagcaagacaca

SEQ ID NO: 7997 - DNA, 171 bp, Bacillus thuringiensis
atcttcccaaagtggttagactatagttcagaagatagcaagacgcggtatctcggtagctattacctgagcgaaatgaactacctgaagagacatcccctagatggggatgggtttttttatattaagtaaagcacatgcctactatgcaaaagccttgctactatggtg

SEQ ID NO: 7998 - DNA, 268 bp, Bacillus thuringiensis
ttgatactgcttatactctaggcattgattgaagaaccaaagcacgaacgaaattatgcgtttccaacaggtgaccgatatacggcgcaaattccatctaacattgctgatggtgtaaatcattcagaattagctctcattatagtagaaggtggattcccaaatacagcagcgacagtgctaaattttgcgtccgtgaaatctaccgcaccggatgtgggtcctccgacggaaaaaccttttgttgctgaccccttttatactaaga

SEQ ID NO: 7999 - DNA, 519 bp, Bacillus thuringiensis
agccaggcgaccaaaacaaaaacggactttagtatcggaaaggaaaggaaaccacgcagcaggggggagaacaaaaaaaaagcggggaagcccgaagaggcataaaaaccgacagccagacgaaaacataaaaaacacctcaataaccgccaacaaaaccaaaagcgggccaaagggggagaaccacggaaagaacgaaaggacccgcaaaacaaaccaaaacaaagccgatggaacacaagccagggaaaaaacagggcacaacaaccgaaaaaccaaaaagggaaccccccgcccgggacccgggaacacggaaaccaaaaacccgggccaaaggagccaaaaaacggccgaaaaaaccaaagcaaaaacaaccccccccggaaacaaccgaatcaagggaaagccagaccgggggaaaagggcccaagggaaaaaaaaccaaaaaaaggaacccccacccaaaaaaaaaaaaaaaacaccggaaaaaaaaacctccgaaaaacgcaccaaaaaaaa

SEQ ID NO: 8000 - DNA, 109 bp, Bacillus thuringiensis
ccccctttaaggcggcacgtcagacgtttgtataacgccccatctttggagctagcagctgtgcgacatgatgaactccatcggacatactcttaataaagctggctgt

SEQ ID NO: 8001 - DNA, 291 bp, Bacillus thuringiensis
  unsure (1)...(291): unsure at all n locations
aataaacaacaaaataaaacacccacccaaaancccgacaggagacgctcacaaaaccaagcggggcgcaaacccgaacagaagaacagcacccaaaagggcagcggcaaaacgagaaaacanaccgagcgacggcgcacacgaccnccaaacaaaacaancgccaagcagcncaaggcgacaccctaaaagccaaacgcaagacaaacagacaagaagcccaanaccagcaccgagaaaacgagcagaaaacggcgcaaacagccagccaaggaaaagaaaaccgagcaa

SEQ ID NO: 8002 - DNA, 321 bp, Bacillus thuringiensis
atacatgtggtttgtttggattaagagctcgctctaaggcagtgcgtgccggacagcaaagggatactgtgagaaaccgtgcccataagacagggataacttcgggcaaccgcttctaataccggataaccttagacactgcatggttcgaaagagacatatgtacttcggctgtcacttatggatggaccgcgaattgaattaactagttggcgaggcaacggctcaccaaagcaaataggcgtagcctacctgagagggagatcggcctatcagtccctgagacacggccaagactcttacggaggcgttagaaaataa

SEQ ID NO: 8003 - DNA, 218 bp, Bacillus thuringiensis
cgagcatttgttttcccaccggccagaaacccaaaaaggggggctttaataaacactggggggtacacaacacccccccgacaagcactaacaaaactcccacccttcaagcccagagggggaaaaacccgacagcaccataacgataccaggccgctatcccttcaaaccccctcagaccccctactgctgccgacccttccatagacccccccccc

SEQ ID NO: 8004 - DNA, 113 bp, Bacillus thuringiensis
ccccacgcttgccaagtattctcccgactataggaagaagcgccatagcgagcgatatatattctgcgaatagttgaacctgtaccgtcttactcaatagaacgatggataca

SEQ ID NO: 8005 - DNA, 154 bp, Bacillus thuringiensis
  unsure (1)...(154): unsure at all n locations
aagacgcgagggggggtttttggaaanncagggggggaaacaccagggcanaggcggnancagncaccggaagaaaggccngccangnccacaaaanaggcggncacanggagaaaacccnacgangacgaaaaagggcngacaaaagccagcc

SEQ ID NO: 8006 - DNA, 507 bp, Bacillus thuringiensis
ttactcgtattacttatcttcttattcgcaaaaaaattcacaccaaactcattcatgatgactagctttaaaggtaatagctttaggacattttcaatcggtattttaatcgctgccatactctcactttcatatggaacttatcatgcggtaacatatcaacctagttatttagatattaaattaaaaaatcaaaactatactgttttcggtaatataggcgaattcggttatttctccgaagaattattaaaaaaagatacagaagtacaactatatttcgtctcttggaaaacaatacagttaaaaaatccggtaatacttatagaatatccttcaggaaaacaagaaacatggaagccaaatatcgtatcaataccggtaaataaattacaagaaaaacaatgatataaaaagatatttatcaactatcaccgtattcatttaaagaggttggtgaaataacatttaccattaaagaaaacattttaaaaacaatccaatttt

SEQ ID NO: 8007 - DNA, 133 bp, Bacillus thuringiensis
atgctcgaaggtgcaatctctaagattgtggatattgttttgttaggtagttcatccccatctttcgggggggtattcttataatatttggggcactgttataccccactggagactatcagttcattgaaac

SEQ ID NO: 8008 - DNA, 383 bp, Bacillus thuringiensis
agctcccctacgctggggatgctaggctacgaatccaaatcagggtacacttcggtttttctataacattaaacggccaaggactgagtctatccatatgtagaaggggtatgcagactgactcctgtttgggaacaacctatttggcgagaaactggggatataatacatagttaatacgcagctagtatgcaattacaggattctattttataaaaatctaatctaaaaaccctaattatttggaaagggccttttatttggcgcaatacctaacataagtgaacccttggacaataaaacttacctaaactgcaccgaacaaaatgttattggtgcaactgagtgccaatcaaggcaagctggcaatggcatgcaaacaa

SEQ ID NO: 8009 - DNA, 396 bp, Bacillus thuringiensis
ggccccgaggcgcctggcgcccagacacaaattcaaaaatacctttatttactggcaccagaaaaaaccaggggtgaggtttcccggaccaaggccattggtttttatagccccaaaaaaccgaaccccccaaaagggacaggcccaaaagccccgggtaaaacaaaaaaggggccccccaggaaaggaaggcccggccttttttcccaacccccactggaaaattgaacttttcccggcggggagggaggcaccccccccaaaccaaaaactgaacccccctattttttgcccaaatttttggtttttaaacccaaaaacctaaaacccgggtgataaaaacaggaggattcaaaccccctaccaaaagaggggggccaaggttgttgaacccag

SEQ ID NO: 8010 - DNA, 359 bp, Bacillus thuringiensis
gaaggaaatagctcagatgagccacaggaccgccctttgtcgtaacgactaatttatatgagacgagcgagatctataactacgtgtgcattgtgtttttgcatagatctcactgaaaccttctaccatgcattcttatgcgcattatacatgagactctgactctacatgaactgtctgattgtcacgatatggggaatcttctcattgtacgtcaacgtgcacaagacataaacgtgtatgtgtcaaccattacgttgtatatccagtgctgggacattgatctacagagcatgcctattgacaacacatttctttgcctggccaacaggcaagagggacagtgcctctgtcaatac

SEQ ID NO: 8011 - DNA, 115 bp, Bacillus thuringiensis
ccctgcaaggcgacactacagatgtttgcacaaagccctattttggcagctggcaactgtgcgacatgagctacttcaagagacatacttttgataaagctgtttgtatatacat

SEQ ID NO: 8012 - DNA, 211 bp, Bacillus thuringiensis
gacccggacaccggaacgcgggggactaaaacgaattacgcggggccaatagaaacgtacgcattgatcttacaaaaaagtgtgatcggcgttccaccaaaaatatcttatgcgtggacatgaacagcatcttactcatacaacgtggccaaaatgactctattgttcttaagaggatatgggctcgcagacagcgctaagtagaaaagga

SEQ ID NO: 8013 - DNA, 340 bp, Bacillus thuringiensis
gtgcgtgcttctcaatctacataaacctaggtggctcaattttttttctcagccgcatccactgcccaaggtcgacttatataagactctgagtgggacatatcaaatcccccgcttttacaggctgcacgctcatggacacatattgtacatgttgagcgatctcacacacctaacatttacatcccccactcccctatgttaatcaaacttacagagtgaaggcctcctctcaaccaataagcgcctctacctcgtcagacatacgcagaatggcccatggtcaccacatccatcccattctccactactacaaaaacagaggtaccacaccttcaac

SEQ ID NO: 8014 - DNA, 247 bp, Bacillus thuringiensis
accaaactactcacattgggggagggactactgccacattggggggctgctctattaatactcaggagccactaacaccaactgatactgatgccatatgtacatataccttttactaccacatgtactcagcggcaccacagataaaagccacttacccaaaaaactcatactggcattactacactacctaacgggaccacttttgttgaaacacctgtgatttcataccgcacttacccttagt

SEQ ID NO: 8015 - DNA, 338 bp, Bacillus thuringiensis
agtgcgcgatgtcaatccatcaacgattgggagcactaatttatttactctactattattaactctcttggcagggttatgcttaccactaccaaggcatgctagagctcacacattttattacagctaccgaatgcattgaaagaatgagctgtgtattaccaacaatgattgactcaaaaaaatactgagtcatatgtatcggcctcataatgcacaatggcaaactcatagtaatatcccaaaaaacctctcgcatgatggataaaacgtctatgttgactgactcgagatcagccctacctctatagctaccgataaacctactacgcctaatg

SEQ ID NO: 8016 - DNA, 262 bp, Bacillus thuringiensis
  unsure (1)...(262): unsure at all n locations
cgcacaacctttcttgaaacagcgganacccccccccggggggggccaaacaagagaagggcgcgacaaacacgagaaaccggaaaaaacacccaanacaacaaaccagaccagacacgcgcagagaccaagccaagaacccaagcaacccgacagggacacgaaacacgagcccggcgaaagacacggacacaaacagacgcccgagacaaaacgggacccgcccacaacgcccacacaacacacaagccgaacagcaaaa

SEQ ID NO: 8017 - DNA, 295 bp, Bacillus thuringiensis
  unsure (1)...(295): unsure at all n locations
tgctcgaagcactataagggcttctgtataagtgatgcgaccgaaatgagagaaaaatgcatacgctatgcgcccaagaactgtaatattgacagagctgaggaagaatatactttataatggcgcatgctataatacgcatttgatggcatagttcagcatatcttctgtaagggtcattacgtcccaaaaatcagtgaaggcaatttatggtacaccattcagaacttagcantgaagcgtgctggcgagggcgattctgaacggaaaggaagattggagcttttagacgaac

SEQ ID NO: 8018 - DNA, 118 bp, Bacillus thuringiensis
gacgaaagaggaacctgtgcagctcgaatacgattgtacgcagtaggacgtaatcgtagtggaagaagaaaaaccaagtccgattatcatattaagcaggccagacacatacaccgta

SEQ ID NO: 8019 - DNA, 295 bp, Bacillus thuringiensis
  unsure (1)...(295): unsure at all n locations
aaagaaaanaacagcaccgaccagangcaccaacacacgcgggcccacaaccacaccnaccacggaaacacgcaccacgcacaaaaaagggaccacccccgaacnggcaagaaccacgaaaagacgccgaacacacacggacgcgcgccacgcaaccaagagcagangacaccccaggaaaaaggaacgcccgaagagaagcaacaacaacaaacgcaggaaccaccacccgaacangggcagagacacgcagcaaaacnagccccgacacaacaaagagagnaccaccaaacac

SEQ ID NO: 8020 - DNA, 125 bp, Bacillus thuringiensis
ccccgctagaagaggtttgtccaaactgatgaatgaagctcaatctgcgtggatataaccttgacgcaaggaccgacactgagaggcataatcaaaagtggggtggtcctaaatacaccacgtga

SEQ ID NO: 8021 - DNA, 101 bp, Bacillus thuringiensis
ccccccagcgaagggacattacacacgagtgtataaagacgtatctcggcacctggcagtagtacgacatgaacaacaccaagagaaatacccttaaaaag

SEQ ID NO: 8022 - DNA, 166 bp, Bacillus thuringiensis
gactagatacatcttcatctttatgccactttttttttgtacgtcgtaaacgctgagcggggtggggttttcgatatgaacaggtgacagccttaacaactccagcgagtcgaagcaaccctgatcgtgcttagtctggttagttcttctgtatttacgcccacag

SEQ ID NO: 8023 - DNA, 125 bp, Bacillus thuringiensis
cattgtaggtgtggttagaccaaactcaacaatgattcttaacatgtctggatctagtttcgtgttaaggtctgtgactgcagcgcataataaaaagcgagtctgtcctaattacgctttttgag

SEQ ID NO: 8024 - DNA, 156 bp, Bacillus thuringiensis
tttttcccaccggggtaaaagttcacttcagattttaggaataagttctatcgcggtacctatcaactttgcgaaatgatacacaataagagccatactctagaataggatggttgtctccacattaattagcggacatcccacctatatcgactc

SEQ ID NO: 8025 - DNA, 137 bp, Bacillus thuringiensis
tttcccccccatcaaggcgtcacttcagatgtttgtataacgatctattttggcagctagcaattgtgcgacatgatctacatcaagagacatacttttaataaagctgtttgcatttccattaattacatggacac

SEQ ID NO: 8026 - DNA, 292 bp, Bacillus thuringiensis
tcctagaatattttccgctacacaaccaatcaccaatggtggaattaatacaacccaggcggcttcaattacgtctgttataggatcatatccacttgccaccacagtggatccttgcccaccttctacatactgcacgaccatgccaaagataaagctcattctccctatccgcttctttcgaaagcactttacctcgttgaggtgccacttccatagatagcacattatgcttccctgcactaaaggccaattcatgaactgttctatgctgaactatctgtgcttcatc

SEQ ID NO: 8027 - DNA, 481 bp, Bacillus thuringiensis
ccccccccgggggggttaggccttccccggggttggaaaggttggcccccaattcaaattggaaaaataagcctctttccctccccttttttttttaaaaacccttttaaaaaattttggggaaatgggcggaaaggttttacaaccaaccaccatttttgttggggaaaaggggagaccccccccaatttttcccaaagggggcccttaaaccggccccataacttaaaaatttgcccctcccccaaggggcaaaaaaccgttttttttttaaaaaggctatttaaaggggtgacctttttttaggatttttccattccaggaggattcccactttttttgggaagggttgtttcgcttttaacccctttttttttggaaaaacctctttaaaaattagggtttggaaaaaagaaaccaaaggtttccgggaagggatttgccccccatttgtttggggcccagccaccgcccggggggg

SEQ ID NO: 8028 - DNA, 151 bp, Bacillus thuringiensis
agtatatcgcgctactccaccaaatcctggagtacaagggagagacaatgtgcattctgcaaccaatgccatatcgcttaaatgaaccttaaacatgggcattacttattgtaaagcagaaaggtcgtatcttagtaggatagggcattgc

SEQ ID NO: 8029 - DNA, 143 bp, Bacillus thuringiensis
aatttagcgaatggaacacactagagcgacagcaagtgctactaataacggaaaaatagcaaccaaccctgacattgcccaacctatacctggtataacagcaaccattggggccaaagccacgaatgcccccggaattacac

SEQ ID NO: 8030 - DNA, 119 bp, Bacillus thuringiensis
tatagatctccacgtttcaacacttttatgctgcataaaagattgccgcggtatcaggggggatcttttaccagcctccgcgcataagaactgctcgtgaggccttacctcacgcagct

SEQ ID NO: 8031 - DNA, 131 bp, Bacillus thuringiensis
ggagctcatacggcctgaccataacagtgtcactacgaaaaacccgatatagtgcagaaacaaatgctttaccactcaggacttatgtggctccctgagtaagaccagtggggtcgtcggttttggttgtc

SEQ ID NO: 8032 - DNA, 108 bp, Bacillus thuringiensis
gattggtgaattttgttgagcatttacatcatcgcgccccggggggagaagctatggtcaccctgggtgcatgaatcctgatgaagagaattattgacaacgaaagcc

SEQ ID NO: 8033 - DNA, 318 bp, Bacillus thuringiensis
  unsure (1)...(318): unsure at all n locations
gccaaatacttcaacaggagaaggtggtcagagacttatttgtgcacactgcgactagttagagacttgatagatagcggtaagactcgttcttacaggaatactangcacaactagacgcttaatgacactcgtgcacgactgcggtgcatctaggtctatacagactggaccgactgtgagcatgtgatactatggaaaatagtaaagaggggctatgagtgacatattatctgtctgatctaaaggcccttgctcaaccaggggtgatacaacaatacgcaggaggacctctaggaccataaaaaaggcattatc

SEQ ID NO: 8034 - DNA, 143 bp, Bacillus thuringiensis
tttctttaaagtactcaaagccgctcaaagaagctgaaatagaggcttggatccgctatatatgagtctctctatatgagcaaaacggaatctgagcctctcctaatgcaagcccctaatattacacgatatattccacaaag

SEQ ID NO: 8035 - DNA, 135 bp, Bacillus thuringiensis
tccgaccaagtaataccaagcttccccaaatcgccgaggggatttataaacactgggggtctacccaaaccactgtcaaagccaggccacccacacgtctgcacaccaaacaacgcgcgagaacacccacaagca

SEQ ID NO: 8036 - DNA, 140 bp, Bacillus thuringiensis
gaagcgcgtcgacgcatacagatatatatcaaaatctcattagcgttattatgaaaagctaaatacgggggcagacaggtatcgtaaaccaatcgacgcaacaagagtaacaaacattgtatgagaaatagtgtgaaact

SEQ ID NO: 8037 - DNA, 148 bp, Bacillus thuringiensis
  unsure (1)...(148): unsure at all n locations
gcacaagaagcacgacgaagaaaaaagagagaaaaaattattatcaagcgcacaaccaacagcaggaggggggggncaataaaaaacagaagaggggaggcagaaaaaaacgaaaagagcaaaaagaaaggaaaacaccgaaaagaaa

SEQ ID NO: 8038 - DNA, 139 bp, Bacillus thuringiensis
agcgcatctagccctacctgctgatgagtgatgtgcgggacatactgcgggaataagagagtgatgcttgcaagtgggacttatagcctccttggggagcaaagccctatgcactcgaacatagagcaaaacaaagcct

SEQ ID NO: 8039 - DNA, 433 bp, Bacillus thuringiensis
tccattttttatcacacgctctgtcctgccatacgaaggcgaccatatggtcgtaaagaacggtaaacgctttatcagttcgaaacccactcttttcaattctctagttaagctccgggcatgtgatgaaataaggaatcatttacgattcaatcaagtcccaccgtattcacgtgccttgccctgttaatttattacccagccgccagattataaatcatcgtaaagtgtcctggtgcttagtacaatggcgcaaggttgtttgacgcgagttttctccatttggatctacttgtttttcttctttccgttcaatatgaaaggatttatgtttttacccttaagatgtcacttttactctgaagctctcaaatagtttctttcccgaggaatctgtaaatggcctgaatacccgttggatttgactaccaaa

SEQ ID NO: 8040 - DNA, 114 bp, Bacillus thuringiensis
aaaacaacccgggggggacaaagaagcccaccaatccaaaataattcccaacctgtctttcccccttccctaaaacccccctcggggggaattttaaaaaatttttcggggccc

SEQ ID NO: 8041 - DNA, 123 bp, Bacillus thuringiensis
gcgttgctattatcgaaaattacgactacaacggcctatttggcacccatacaaaacgcactaggcgaagcaatatactattcgagtactatggatgccgctcccaacaggtggtgctcccat

SEQ ID NO: 8042 - DNA, 167 bp, Bacillus thuringiensis
  unsure (1)...(167): unsure at all n locations
ggaaagcgannagngaananaaaccgaaagagcnggccagaaaacaagcgngcgcccaacaacaaaacgaggcnccagcaganaccacagnggaaaagccaacaagcaccgggcggaagccagacaaaaanacaggcnccccgcaaacagaagaagacagagaagcg

SEQ ID NO: 8043 - DNA, 209 bp, Bacillus thuringiensis
atatcaactgattggcattaggatcaacattgccctaatccgatatgggaagctgctatatgtctccatgtctgatcaaagccattacctgacatcaacgctttatataccggtccgtgtacgattacagcaacacttgcttattttttgaatttatatgaaccacttcttaacatagttctgtagagatgaagcgtttaccgtattaa

SEQ ID NO: 8044 - DNA, 122 bp, Bacillus thuringiensis
tgtggcaatggaagatagtggctgcttaccttaaacagcccaaactgctgcggggatagctgtttctatgcatggtataactgctgtccaagcgctagactcccatatcgaatgtgttgtcc

SEQ ID NO: 8045 - DNA, 143 bp, Bacillus thuringiensis
ggcaaaaaaaaagaggactgaaaatagctctaccgtgtaatttaactactgcgcgaaaagttgcacatgaagagacatcctctacatacggttgtctttaggtactttacgtagaggacatccctactatgtttactcggggc

SEQ ID NO: 8046 - DNA, 121 bp, Bacillus thuringiensis
tccaaccgaacggcataaagatgaactgccacataaaccgagcaggggctagccaaaatgtgagggagtctgttgaaagtgactacttgacacctacgatctatatactatggtcacatgt

SEQ ID NO: 8047 - DNA, 295 bp, Bacillus thuringiensis
ggctctcgctcgctatttacgccgccaaacactttttctggcgttcaccgaccgatcatggcggggggggtgatgtaaacacatgaccgacgtgaactgctcacgcgctcaaccgactccttgattttataagaaatgcactcaatatcgcagcactccgtgggcctggaactaacatttggctcatccacaggtacagtgcgcgaacgcacatggacatggacgccatgcaatggttacgggtcaccgcttttctgtaacggtttgatcactgctcatctactgcctactcatc

SEQ ID NO: 8048 - DNA, 167 bp, Bacillus thuringiensis
gatgcaaagaatggtaaaaatgcagacaaagctctagacttgccaatcagaatgtgaagtcccggatacatttgcggagggatagtcacacgcaagttctgtacactgactgtcaaggatttagcgaagatctagaactgtggatgggtaccgaaaggctattttca

SEQ ID NO: 8049 - DNA, 279 bp, Bacillus thuringiensis
cacacgcttttttttacagcattgaaccagacataaggagaccttttttcacggataatgggcatgctccggatacgttcccatcaataaatagagcattatgccgctccctaaacatgattccacctaactgaaaggtcatgatccgaactaagaacacctcctgacttataacgtcgaatatcttattggaacgctagggaagacatcacacctgataaaggggaccataataacaacgtgggtgttcttaaatgtgagatacccgatttaattcgc

SEQ ID NO: 8050 - DNA, 111 bp, Bacillus thuringiensis
aagtcggataatcagcaggcgcacagatgctgacatggggggctatagaaagaaactcggggtgaacctctaaatggattgccgcaagtgtcaatacaaatccattagcga

SEQ ID NO: 8051 - DNA, 429 bp, Bacillus thuringiensis
atagtacagttctgtgaagaaactcctaaggaagagctcagcccaagatctgaacaggaataatagaaatgtgcatgtggtggttgcatttcattctggggacacctgggcatggccctcagggaaggtcctgtgtgcctcacacacagctctgccctggacttcatggactcacagactcttccgaaaggcatctgtcccttacatatgaccccagccaatgctcctaatagttaaagaatcacttaatctgaagattgaagagtctgcatttagactgcttagggaaggaactgcccatggctggcagtggtgtgcccagtgacttcacctcttggttcaatttcctggtcagtaaaattgagatatgcactacctccttcttacaatagtgcctgatacattgctagccttcaacaattgggaaat

SEQ ID NO: 8052 - DNA, 129 bp, Bacillus thuringiensis
ccctcttccccgaaatacacactctctggtaccgccgttcggaaaaaaccggggccttgccacactgaagacatacgagcaccatttccataaaaagcaacgctaccgttagagggcctatacaagccc

SEQ ID NO: 8053 - DNA, 245 bp, Bacillus thuringiensis
agtcccatatcgtcacttttaaaactccaatatcctgatggctaatgcagtaacaattcagagcgcttttttaagatccgggcggatttgttaccctaagggaattcgcgacttctacttttggaatatctctaatgtgaaccagattttgcaattggactatttcctatatcaatagatcgatccgaacttccagacacagtccatgattatactacatcatctggttcagacggattatataa

SEQ ID NO: 8054 - DNA, 239 bp, Bacillus thuringiensis
ccaaactgtgctaaactaaaagctaatgaccttgatggaagtcctttcgaaattgcaccggtaatccaccatgaagtgcgaccgcttgcacaagcactgtatggtactcgacattttactcaagatgttctaatgcaaagagtacgggaactgctacatggaacgtcgatggtttgccagctcattcaccaagatgaaacctgtctggcgaatgatactataacctgtagagactcacc

SEQ ID NO: 8055 - DNA, 163 bp, Bacillus thuringiensis
gataaggctcattttttttagaaaaaagataagagaaatgcggcggatgaatatacacattacttacgagacagtctaatggaaggtatgatgaatggcacgaaatcgaacttaggggtggttgtgactgaaccgagatgaaattgtgtgtactgaaaagaca

SEQ ID NO: 8056 - DNA, 173 bp, Bacillus thuringiensis
tgtaggtttttttggtacacaaaaatagcgcggcacggacagcctacatgctgtactgcgaaaacgatccatgcagagcctgacctaatctaagttgcgcactctggggtgcaatcagttggatagaatgggggggatcaagcgacgcatccagggcgggtcccgccggaatt

SEQ ID NO: 8057 - DNA, 389 bp, Bacillus thuringiensis
cgggcctggagaggttggcccccaattaaaaatcgggggcttttttttttggggcccgaattttttctttaagggggggtaggcccaatggttgggaaggcacatcctcccctacggttttagaatgggatctaacatccctttttttttaaggttgggtaaggggaataccccctacctctttttttaaaaagggcacccggtgggcctttatttttctttaccaccaaatatatttttttttggagggtgggattacctattttaaaccggtgggaaattttgggagcccttggtttcccttttaaaacgggggggcctttctcgggaaatatttttaggggggtttttcccttaaacctccctaaaaccttttccaaatttctcaa

SEQ ID NO: 8058 - DNA, 146 bp, Bacillus thuringiensis
gaccgcgttgttgttaccgttctacaaagtaaaattagggggggttgcaataaatacacacctttctaccatatccctgctctccgctatcgtatttaaaacattattacagttttttcaagggcaacagctgattttctcctttt

SEQ ID NO: 8059 - DNA, 192 bp, Bacillus thuringiensis
aacacaccccaagaaggaacgcaagaccccaccagacaaggggagcgcgaaaaaaccatccgtcacgccggtgcctcctgcacgcaagaaaaggagacgtggctaaaaagaaaaaaaaccacgctaaaaacaaaggaggaagaaaaaccgtagggcccccaagcatgacactcaatgaaagaggaacaacaa

SEQ ID NO: 8060 - DNA, 101 bp, Bacillus thuringiensis
aaactcatcctcactctcaaagacgctaatttaatatggagaatcctcattcgcatctcggtgaggcagaggccgcaatcactcagagcatcatcccagga

SEQ ID NO: 8061 - DNA, 560 bp, Bacillus thuringiensis
cgaaatggtctacctagagacagagaccgacgaagaggaagcggcatacgcaactccacctagaagggcgaagagatgcaggaagagaagagtcatgtttactgagcctcggtagacttgagagacggctgtgacatgcggatgaagacagaagaagagcttcagggaatgggataaacgccttaagtagtcggccattgaggtaaatgatttgcattatacggtgtattatgccattctaccagactactgcgtaatgcaataactgaccgaacagtgagagacgatgcttgcggttaatttctaacgccttgatcatattcttcacctatgtactcgctatcgtgcttgcttgaacaagtctatcacgagtgccggaaggtcttttaagctacttggcggcacatgtgttttcgaactgaagcaggaaccctgcctgggttaaactaaatgaccagccattgtacgcaccgcagagattccagtacattcgcagcgaaagcataccgaaactcagtgatacaggggtgatggtgcaacgcgtgccaaatgtacctact

SEQ ID NO: 8062 - DNA, 220 bp, Bacillus thuringiensis
gataggtatatcgtattcgcgcttttacattctatttttttaaataagtggtcatgccctgttggcgaggtgtactatctttctaataacagcactatcaagggaaggtctattgagcgcagaccacccacctaagttctttgctgtcgcagaactttgtggtgggggtaatagtgcgcgtttatgcgggattaactggttgaaaaaaaaacatataata

SEQ ID NO: 8063 - DNA, 287 bp, Bacillus thuringiensis
ggcaaaacgtctttccacagaaataggccgcgccgacgggggggatttatacactaaacggcagtaacacgctaagctccactctacactcaggttctaggctttactccgtacagtcctatcgctagaccagcttttcacaagtcggcgctacatctcgtgctgaaaaaaccctacctttccattaaaatggcacatgtcctcctttgtacggtcattactggcctcgcgttgttctaccttacggtttaataaatgcatgtcggtctccatacacttggtgcagc

SEQ ID NO: 8064 - DNA, 498 bp, Bacillus thuringiensis
  unsure (1)...(498): unsure at all n locations
tggcaaaacggattatcttcccgggggactgctaaagttgaacacacgagtctgtatgtgacccgagatggttatttggccctaaatgtggtgcccatacgctgagcaacctgttggacatatttttcaatactgtctacagtaacctctggatggaagctatcgcagccccattttgttcccctgtgtccagagcagacttccgcctcaatgggagtaacattaagccgtcaggcgtaacacgaatctcccggacgccgtggccttgaagggatgaggccgatgatgacggctgacatgtgggattgttttcgaaggcacaaatagggttgcctatttgtcttgaacctaggtaagtcaaaatcagacaggtgacttcctgtgcaatgttctggagtcataaataacatacatgtgatcaaatacttcttnctccaagcagcctagtaatagttagtccgaggcctctatccggatgtcagagtatctgatcaactg

SEQ ID NO: 8065 - DNA, 153 bp, Bacillus thuringiensis
gagattatctcttgatgtaggtgaccaaccatgattataagaacctgttgaatatccgacgaggtctctacattatatcattgacacgggaacatcatgcttttgttacattgagatcagggagaccctcctgcatatggcttgggtttgtta

SEQ ID NO: 8066 - DNA, 190 bp, Bacillus thuringiensis
cacaaaatgtctctttcctgaattaggccacatccctgggggggttttatttactttgcgtttgttacacgccaaacaaatttagtcgctcacgttatatttttttttccctccgctacctctatcagaccagctttttaccaactcgaagctcccttttgtcctttactgacccgacatttctatttat

SEQ ID NO: 8067 - DNA, 126 bp, Bacillus thuringiensis
cgcgctgtttttctcccatgagctcccccccgggggggggtttaatttagaccctgttctgtaacgacccgcgaaccactgttcggcactcacgatctctgttttacaccgcctgatcttggtgtc

SEQ ID NO: 8068 - DNA, 170 bp, Bacillus thuringiensis
cgaaatttctgtatccaatgaactaggcgccggccgggggactgttttagaacctgggcggtatcaaccctagaaacacattacgccacccacgctattggtgacacactgcctgcccatggtagagaaacagcatgtcaccctccggacccacctgttgactatagaat

SEQ ID NO: 8069 - DNA, 162 bp, Bacillus thuringiensis
gagtgagcgatgggacggcctactaacaaaagcgccagctttttttaatgcaactgctactaccatcaatataaatacgaggaaaacagaccgaggagaagataaatgaggcggcacagcagcctatcccatgacagcaatcccagtaaacactccaacgaa

SEQ ID NO: 8070 - DNA, 361 bp, Bacillus thuringiensis
aaccgcattgttgttactgtaaatagtgcatagtggatgctgcgctttgtaccattcctcgttagagaaatagatatgcttgaacattataaatgcactcgggttccgaaggtttttaatcggtcaacattacagtctttgatattaacacttctataagaatatggcgttaagaacaatacatgagcatatagcatatagccatatattacataagatatatgaagatgttagcatgtcaatatgcatttgattgcacatgatatagaccgtggaataggatatcgcattatatataatgatgaagttgtatgccgtgcatcctactatacgcttgatacgatggggttgaaattgaagt

SEQ ID NO: 8071 - DNA, 100 bp, Bacillus thuringiensis
caagttttttttatccaatgagctagccccctggggggggttatattgcgctccctgccggtttttaaccccgcaaaactgtgcggcacacaggattatt

SEQ ID NO: 8072 - DNA, 261 bp, Bacillus thuringiensis
attctgcttaaacggtatagataacctccgcaccattttgttttaccaatgccaagaaaatcatggggaggggtatgagcagtaacaaccgtagagaaaaaggatgagcgcagctcgttatttaataaagctcacaggctgcccacggcctggaccacatgcgtttagtcggagcgtggccctgtagtcattgagatatgcgggttctaacaacggagttagaattgaactctcctcaggaagaaggacaaggttttccat

SEQ ID NO: 8073 - DNA, 126 bp, Bacillus thuringiensis
cacgttttttttatcccatgagctacgcgcctggggggggcttatttcagcccctttccggttgtgaaacgcgcaacactgtgcggcactcacgatctttgtttttccctgcctgcgcttggtagt

SEQ ID NO: 8074 - DNA, 117 bp, Bacillus thuringiensis
  unsure (1)...(117): unsure at all n locations
cgcgaccaaattttttttgncccaacaccacatatttcattggggggttttaaaaaaaagcgagggccttcgaacataactgaacagaaagaatccacttactagtgaactctaccc

SEQ ID NO: 8075 - DNA, 345 bp, Bacillus thuringiensis
gtgattagttacgccacttctgttcccgggggaccaaccttttttttaatgtacggcctctgtacagcaggggtgtgattaacaccctactcagtcaacaatacaaaaaggcaggccgctagatctgcatatactatacacagctaaagagccgttgcgttccctgagcaaaaacagatgactaaagtagaagatcttgatagggctcctctggtacgtgggcaatctctacccgtggaacgacacgatcctaacgatgtcaaatgccggggtgcaacgcctgataaaaaggcgaaaactgctgatcccgattgactaccacgggacttacactaagttgaagcc

SEQ ID NO: 8076 - DNA, 157 bp, Bacillus thuringiensis
ggaaatttttgtatccaatgaattaggccccgtcggggggattgatttagaacctgggcggtagtaacaagcgaaacacttttcggcactcatgctatttgtgttacaccgtccgctcctggtgtcgaaccagcttgtgaccatccgtacccccctg

SEQ ID NO: 8077 - DNA, 310 bp, Bacillus thuringiensis
cattactctgctagagggaggagagccaatgacacatggtgtgtaactagaatatgactggaagagaaaccaatgaaaaggatattgccgtttactttacatgtttagcgcggaaacaaaaagcattgggagtgacaacaataacgaaagcaccaaaacgactgtaatggaaaggattgattggtagggacacccttgataaggcagtattacaatagtgcccgtttgaggtcggattactgcgaaaagggaacggctgattttaatagaagtctgcaaagtttggaggctgaatgactgtacacgtctg

SEQ ID NO: 8078 - DNA, 583 bp, Bacillus thuringiensis
  unsure (1)...(583): unsure at all n locations
cggctgtttgtttctggcacatgaagcgatctcgatcgaccgattcggtcctgaaacacctttaacttgctttggaattggcagggcgggtgcatgcagggtcccatttcattctgtctctggacctgagtctagtcctacctgaggtagggctggcggctatagagtacactagggcaggtagctatataatgcggtagacctcgatctcttctccccctcccctctacctagtgagtctcatttctttcaattctagtcattccttttcccctgtttttcttctatacattcctttgataggacttgttcttcagacatgcgcatcttcagtcttgcattggggtttctcccccttgtggccggccacaccctcatgaccaccctctacgtcgacggcgagaaccaaggcgatggcgtatgcatccgcatgaaccgcaacgctgaaaaggcgacgtttccgattagtccgcttgcgaacgatgcgatggcgtgtggtgcgcacttgccccgttccattcttgataccaccaaccttaggaatattgcttgtgctgatngtatggattcatgcaggttatga

SEQ ID NO: 8079 - DNA, 101 bp, Bacillus thuringiensis
tcactctttttgctcccggaggtaatgtctctttggaatcctcttctaaaaggtccgggactgatgaaaaattaccggcacacaccgggattggcttgcaa

SEQ ID NO: 8080 - DNA, 531 bp, Bacillus thuringiensis
tgcctcacatcgcgcgtttcccgatgaccggggcttgaggcggacgcaggtattgtcctaggtctccctatcataaaggctggcccagctttactggctcctggaagcgcaggcatccggaaatttatgggcccgagcatcatagctctatcatctttatatgccggcgtcagcattctaggctgactctcgttcttctcgtgttcacccggacctgcgaccctgattccacgcagcccagctgccgctactgcgcttttcaatcatctcttcaaatggcaagctacgaaacgtgtcacgaagtctccccgatgtgccctgtcgaggcaacaacctacggctactaccccaactttggcggcaatgtcttcttcgccgtgtggtccggtcttcttggcgtcatacaactggggattggtacctactatcggtcatggacgataatgatcgcgctggctgtagggccgttcatggaactagcagggtacataggacggacgttgatgaacgataacccgtggaatggtgacg

SEQ ID NO: 8081 - DNA, 419 bp, Bacillus thuringiensis
gtggcaatgtgtttgctgtatgagaaaataaattctggggagaggaagtatttgacatatggccgacaggcgtgggaggtgctattactggagcctgacttggtacgagtaatgaatgcgtggattacgacgttcggtcagatggggagtcgaaagcttgcagtggattgttatcatgaagtaccggtaggtcggtgccaacgtttgaggtttggactacagaggttgtaagggaccttggggcgtctggtcaatatagaggataatggttataatttatcagcgcagaattgcgtgcaggaacatgattgttgtgtggtgcgcaatgactgtgggctgattacggtctctttgtcttaaagtaagcagaatagaagtggatcttattaaccgttagaatacgtacataatgagacact

SEQ ID NO: 8082 - DNA, 274 bp, Bacillus thuringiensis
aggcgcgacaagcgggccgacgaagacagacaccagcacttggtccaccaccagcagggaacaacacacaagaggggcacaggcgacggaaacgggaaaggaccacaccgggggcaaacaagagcgcaccgagagggaacgggaaacaccgacaagggaccagaagcaaaaacaaaagaggcacagacgagagaaaacgcacaacacaaagaaccccagccggccgaagcggaaggagagacgacaacagacgcggcagccgcaaaggccggac

SEQ ID NO: 8083 - DNA, 419 bp, Bacillus thuringiensis
attcttctcttttacttggccttttgttctgagagttccagacgtccattttgcatttctcgcatattgactattcatgttatcactgggattcattctgatttactctctaaactggatgttctagaggaatgaagggccatcgtcatggtggaagctcacaacatgttggttggggtctatttactacccttgatcccatctaggaaatggaagtacattattaaggctgatcatctttctgtctcaatatatatgtcagatgccgtctgtagtcacttacctttgtcctttgtctttgagcgttaggtaactgctaatgtaacgaaagctgcttagaaaccgttttgtctcggtctcaagttacacgctcgcaccggatgggtgttttggcgacatatttacgatgtctaccttac

SEQ ID NO: 8084 - DNA, 369 bp, Bacillus thuringiensis
ccctgggtttttgactccgtcattgccatgtgtagaggcgtctgttgtaaagggggttagaaaatctgcgactcatgatccaagcccgagctgagaaacgagcatttgcaaacggctcgccaaattggtaacttaggagcttccgcttttatctgctgcgcaagcatctgcgaacagtgtactccggccatagaacatcatgtgagttggggctcctacatatagacagggtaacacaccatagcagccggtaaactgacaaggggacttacaaggagtatgtgtaaaccagggacagagatgtggaagcacaggcatggttgtttcctactcctgtatgaatgactgagggactgagttcgctgttgc

SEQ ID NO: 8085 - DNA, 493 bp, Bacillus thuringiensis
ccttctctttctcgcgctagtgcgaaagttacaaagctataccatggagacgcatttgttgaccctctgaaggaaataggctggatggcgtttgtgagccagaacgtgcaatggtctttgcacggccttcccgcaaacagagagacaaggtgacgataatagatatggaagatgaaaccgcgcaggagcacttattagctgatgatgatgataataaagagaagcatccctctggtgtgtccgggtacctgcacacctatgctacagccaaagacctgcgattactctacgtcgacggcacctcggctggaacatcggccattggacactcgacagtcaagaccgtattttgtttaacgacactatcaccgggggcatcagtagcgaggatcagcgcgcaagagctgtctgtcagcttgcgaaggatgaatgggaggaccgtcttgacggagtcattcgtatggcggccggcttatagaatatactgtgtgag

SEQ ID NO: 8086 - DNA, 516 bp, Bacillus thuringiensis
gcttggaagacaatcatctagaactcacctttcatctcatggactcagaagcttaaattatcatgttatatcaccgttacggccttaatgagcatttacacattcttcctgaagctgtcaaggacaaaagcgagatagacgactggcatcggccgggactaagtttgtccagaccattcagcgctcttggcgagctgtatgattggtcgactctagaaaggcactccccgctaataccacgtaatattaccggtagtactccgtgccacgagacccccattattcacgcccacagttttgagccctgagcgctggactctttcaagtcagttgtagatacaccgctcgagctggagttcaaaataaggctccggtggccatgtcaagcaaaacagtaaacagtgacttcgtggagacaagcataccaaccttctcgagtccagttccacgactcggaatcgcgcatctctagctcaattgacggccacgaacagaggtgatcagtgggtatctagt

SEQ ID NO: 8087 - DNA, 364 bp, Bacillus thuringiensis
attcgtgatccacagaacaagtcatagtgggagggctaaatcgtgctataggtgatacgccatggtttatagagggcttcgtatgagcaggaggggatccaatcccttgaaacacgccaaacttcaaggtcttgactgtatatgaacatcagaaattgcctcctaaattccgtgtaggcaacagatcaccccagtcatgtcatgtaatgccatacgtatgcccagacactggaacagtcgagtgcatgactacaagagaacttctgaacgtaagctgattatctcggaatccgtagttgacattggtggcgctacaagacatgcactttgttgtttctctgctagccctgagaatgattgataa

SEQ ID NO: 8088 - DNA, 343 bp, Bacillus thuringiensis
cactaccctacacattttaacgtgtcctcttcttcccctgcttaactcccgacccttggggggctcttaaacacagaggggggtcaaataatgcgttttcaccccaagttgactttacactatctaaacatggcgcacccttaccataagctctcatgctactgcgacaatcgactcttgtttatgaatcaccatctcttgtatcctatgcatcccccaatttgctgctctatctaacagtctttcatggagtacctggctacttcttaactcatctttaacaacttcaccctactctaacagctttgccattcactaactctgcttttccaccctgtccccc

SEQ ID NO: 8089 - DNA, 461 bp, Bacillus thuringiensis
tctacgagtcacagccgtatggggggaaggggggagcccgctcattctcggggattactttacggacagtcgtacgcccacagagaagagatttcatgcacagtgattggagcaagtcaaagggcagatgcccaggagcgactcctctttcttctcagtgcgttctatgacactgcggctaatgtgcaggcttgctgaagacaccccactactggcatttgacacgctacatacagacgaatagtccccttggcctgccttagggccctacggtccgtcgaccgtccgagggacttttttcagtctcatctgtcccttgtcgacgagcgggtgatctgatctatagaggtggctctggcgtctctggagtacatctgtagtacaatgcgagtacaaccaaagcgatcgttaatggatcttgacccatatcacacttacaagggtctattgtgtccagtata

SEQ ID NO: 8090 - DNA, 221 bp, Bacillus thuringiensis
ctgagcgcacgttttccatgagtatcccgaccgttgctcagtgttctcaccctaactttggattcaacgcgcaacacgcatagataatactggtggccctggtttctctatagcgcgcagtcgtttggtttggcgttgttagggacatagtggcgtgctgggcgacttgttagcgcgatacctttctacagaggatgcacaccatatggatatagtggtaa

SEQ ID NO: 8091 - DNA, 358 bp, Bacillus thuringiensis
tcgtgatctctaagctcaacctcttttactggcttactcttcccatggtactctcctcacacctagggggacctttaacatattttgcaggggtctcataacttcttaacaatcatccttgactagactgtcctgtatctttaccgcacacgtactctgttatgctcttctagaatatcgaatgaaccttgtctttaaatggcacccactcctattttatccattacactacgtactcctctctataacactcatcctttatatcaagggctacattctctttcatccataacccattctccatactctaaacggtataccataatgccaactttatatcccacactataacccccat

SEQ ID NO: 8092 - DNA, 587 bp, Bacillus thuringiensis
aacttgaggctgcggctgaaatgctggggggtgaacgttattgcgaagcgcacatgccgggtgctacaaccggcggactacagtctacagcctcgataccatctgcccattcgcacatcatccagacgagcgggcttcgggtgcttatactgtatcaggcgagatggtgcgacataaatgcagccttttgaaacagactacccttcttgacagcatgtgtcgatcattcggcggcacaaggtatcgctcatcatatgtgaggttttatatatgactgtttaggcaatactagggcgctaatatatagacaggccgctggtggaacgctaggttcttattgagacggttatcgatgccatcggtgcatgggcgcaacgtacatggattacgttcgacaacacccgctgcgctggcgactatttgttgtctagaagagaaggctaacgatgctgaattaactctgacacaccacagccggtgcaatcagcagcagccaggccatagtggtcaaacgcgtgtcaataatcgaccctcgatgagctgaacgcatgaaactgcagactggagactgggcacacttggatcga

SEQ ID NO: 8093 - DNA, 511 bp, Bacillus thuringiensis
cgatggacactactatggagccactctcggggttttgtgcatggcatggttgtggctgcgcaagagctgattgttggcctgctgtgccagcctgattgctagtagtagccagccatcctatgggattacctgtttaataatccaactaaaggcactgcaggctagagcttcctgcaggatgcttgcacactatggcctgcagcagggaagacatggctggttgactagatcagtactgaactggctgttgcttgagccttcattacccagggcactgtcagtataaacaaggtgcacaagtactttcaggcggtcacatgattcaaagcgaagctggcggtggctgagtaccttactggtagggtgccagtatatgtgcctgagctgctgagcatacagtatatcaatactaacaataactggcatcacaacatcttcattgaggacggacttgtcgtgtttgtgacggcatactacaaggggttttatgcgagcaatgacgtcaagatca

SEQ ID NO: 8094 - DNA, 494 bp, Bacillus thuringiensis
gcccccctggcctggagaggttggccgccaattcaagatagggcccaatttttttcgccctctttggggaataaaaccaattggggatttgtgggatggttaaaaaaacctggcccaggttccggttaaaaaggtaatggagccccaaagggtcctaaaggcggcaaaggttttaccagaaaaggtcaaggaaacctggaaaaatattccggcaaaaataatgggggttgggatccccccaccaccgattttaaaattgggaaagacaattgggggggattttagaacgggaaaccggggggttcaaaaggggggaaccggaaagggtggggggcttttaatccgggggggggattcattaaaaaaggaccccttggcgcgggttaatggggatttccacttgccaaaggaagatttaattcaaaggggggaagaggcgcaacagaaacctgggggccattcagggaggccccaaaaccccttgaagaggtttt

SEQ ID NO: 8095 - DNA, 291 bp, Bacillus thuringiensis
cattagggaaaatagtattttaaaactgaggggaggggacaacgaggggtgtctaaccgctgggagctgtttcagaagtcaaactttctactaggcatcaaggtcctgacttttcagagcgtggctaacaaatcacagtccttgttattcccccgaatggaacagtcgccaaactggccatttgttgaggagcgttctcggcctggttcttgctcaaacgttcaggcgaaaaaactggtggaagttttagcgggcctgaaagaacctatattggcgacaacactacttttg

SEQ ID NO: 8096 - DNA, 367 bp, Bacillus thuringiensis
gcttactgcccatttttttcaacagctgcgttattgtgtgtaagagatttgattggcttagtgctggaagtaaagagaggacaagagcttcgttctggcgaaaacgttgcttctcgctttgcgcataatttaagatgagctggtatgaccgcaagtaggagtcctgggcgctgttcctagctgttgaattcccgtttttggaggatcttgtttattcttgagccatctgctggtggctatttttacagggcatgttgcaatttatacggtaactgatggatagctatgggctgactaagcctttactttatatgtaatgacgaggatttgacttgcttgtgctctaatgagcgggtttcgatttctt

SEQ ID NO: 8097 - DNA, 273 bp, Bacillus thuringiensis
acgcaagaagagaagagaaaacccacgaggcaaccggagcgaggcaacggcgaccgcaagacccgagcgcccaagaggacagcggcaagccaagcgaaaccgacaaacgcgcagagaaacggaggaacagcagaggcaaaggccaccaggcggacagacacggacacagaggcgcaaacggggggggagccaacaggccaagacacccaggaaagagacgccgcagaccaaaagcgcgaagcgcaagagggcacccgacccacagggccgaag

SEQ ID NO: 8098 - DNA, 315 bp, Bacillus thuringiensis
catgcacgattttttttcactagaagatctacgagaaacggatgacggcaggttaaatgttcgcttaggaatgaccggtgctgtagcgttaaattttagaccaaccaaataccggctatggctctctgagttaccgcgttcgatatgccaaccctactcaggtgcgtacacaatggcttgctgcttcaggcactcatagagcagcactagatccaaatggatctccggaaagaccgaacggtttgcttagcgcaaactctatatcgctatgaaaccatctcatagcattaccgagggcggtcctcattgcttcag

SEQ ID NO: 8099 - DNA, 352 bp, Bacillus thuringiensis
atggaagattttaactctgtagtaacatatgctactggtggctgcctcagtatgcgagacatacttaggcgcgcaaaaaagctaaggatgaagaatacttgacactacagtcgatggctggtcgattggatggacagtgcgcaaagatataatcgtgaagggaaaagcctggaggtagatgctaccaacaccaccgtaaacgcggtctatctaaaaacgcgaggcagatgacatccaacactcaacctggcttcactcactcaaacagcatagcagggaacggttactccatctgatgcgatggccgctgctgctcaagcagctgccgatcccatgaagccactcttgacac

SEQ ID NO: 8100 - DNA, 109 bp, Bacillus thuringiensis
aataagctacgggtggtggctatataaaaatatattctctccgcagggagatgaagatagagaagcgacggagctttccctagtatgaacgaatatacaaagtaagcct

SEQ ID NO: 8101 - DNA, 380 bp, Bacillus thuringiensis
catctccttctttttttcacaaccaattgaacgtgcattagatcgttgcactgtatatagtgggttgggatggaccgtatcgtatgcatggtgagtatgtcccatgcgtgcccttaaggcgcactgacagtgccctatgatacatgtgcggtacagcatggacatacagcacacggagggacttcgacctgcgggacatataacgggtccatggtccgccctgggcactgccctacgctgggacgaccgcctcagctaaagagggatctagctaatctatcgtgccaatacggattcatcagggatgacctgactgttacacggacactctaacacctgcgtgtctaccaggtgtctggtacggctggagcaacgggcta

SEQ ID NO: 8102 - DNA, 489 bp, Bacillus thuringiensis
  unsure (1)...(489): unsure at all n locations
cttgaaacgacacagtgattctgatctactgatatcaaagtcattcttctcaaccatttatacttaacgagtgctactcagcaataatggtaactcttatattctcttggtcgggccaaattgatcacatattcacagctcgtgttgcaacacgctcatgcccatcctcaaggcagaagtaatagtattatatgcaggtaaaacatcgctgtccgtactcgcataatgcatctaagtcaccgaaacctctctcttatcccctgcgcccaagttacatatcccgatcgagactcgggcaccgtacccttgcacaccatgtgcttacgaacttagggctctaatcatccgtttctaagaaacctgagcgcaagatacataaggtaggtaggaaagcaccaatgtctccagcaatccaacgtctctccctcgtgtcctcccacctcaattccaacgtcagccgcgctcccaaaatgaccgnaccacgcacgc

SEQ ID NO: 8103 - DNA, 225 bp, Bacillus thuringiensis
gattgaataacagatatgtgtgtcttagacactttttcaccagaaacctacagcattaaagggggggctttcaaaaactacgggggttttcaattcactggaacaagcacaaaggggtgtttctagtgaagggaaacctgtatcgtctcaagaaatgcctcaagcgggttaaccattgtaaattgaaacttattctccaggacaaactcctaagaccctgtttaa

SEQ ID NO: 8104 - DNA, 116 bp, Bacillus thuringiensis
  unsure (1)...(116): unsure at all n locations
gacgcgttcggagcgagaccgaaggcgngatccagcacgaccaaattggcgtaacaaccaaacaaatgggacccaccccagcacacacccgaaaggggggaaacaggaaaagaaac

SEQ ID NO: 8105 - DNA, 157 bp, Bacillus thuringiensis
tgcgggggtcggtagttcggtcaaaccgcagaactttctggagggggcaatatggtaggtgctgcacttatatacttctgaattggcactttttttcccgatgggccctttgcccactctttgtaaccaaatttgccttcacgaaggcataccaagc

SEQ ID NO: 8106 - DNA, 444 bp, Bacillus thuringiensis
cagcgcgattatcttttcatttggaatgaccacagtgcttattgggttcatcacatgaagcgagcttccttttacctcatgtaaaacactagacagtaactcccatccttctaagcaccgcacttcgttatcacgattaattgagcgagcacgtactagcggacagactaatggtgtattttcgtgccctatttcgatgctttcccgtacctgtgggtacacaccagcccatgaggaaagcttatgtttcattgacgtacaattacctgacgccttcacttacttatagttcaggacgcgctgtactgaaagatgtacttgcatgactagctcggccgaattagtacggcctgtgggtagtctatgttgacgcgttctacataccccctagtgccccggattttacgtgcgttgcagttgctacgaacgaacctgctcatgcct

SEQ ID NO: 8107 - DNA, 607 bp, Bacillus thuringiensis
  unsure (1)...(607): unsure at all n locations
aaaccgaggatgcaaatttagtcgggtgattgcagccagcagatgtgtgtgtgctggtggccgaggatcacatcctttgaataatgaagctcagagccgtctcttgtagtgcccattgaaagattggtggacagtagggtggcttcagataactcctactcccgccccacccctaggagcgtacatagcatctaacgctcctcatgaagccctcaagcgtactccatggcttttccagtatcggaagtgccgtccaaggatcacgagcaatgaacctcacaagacgttgatgattttcaataagttcgtacacgcgggtggtcttccacacgcggtattcctcgattccggaacccaggttgcatatgtggtctgttgtccctgtagcgctccggctggtcatcagcatcgggatctaaggtgtcactgaactcatccgttagaaggatgactgtgctttcgtcgattcgttcaactgaaatgcgggaattgcctatgtcgcattgngagcgctgctcataggcgatttactctcgcgatcggaggatactcgacccatatcatgccttacgcacaagatagcctatctcacgtggctcacatagat

SEQ ID NO: 8108 - DNA, 460 bp, Bacillus thuringiensis
gggccagactttctttgcaacgcgacataaagaggacctttaagtagtgggcagcttgcgcatcccccactgattgtcagccctcaccaacggggcatttaatcggcgacctagcttctttgctccatccgagtttcaaggtggccgttctcctacccgttatgcgggctctattgcttggcgattgtgccgattgaagcaaacatatttcaatcaatgcaaaaccgctgatggcatcgatgttgagttctctggcgaactctctgaccacagtgacttatacgcccacgcacgtgcgaatgccgctgatgcacgtctaaagcgccagtgaaccgagggatatggttcatcacaaccttattcttttcaacagggacctactacccaacaatagctaccgtgtgacatgtgtcgggtgattctctatatttacttgcataatgagccaaaggaagcaacg

SEQ ID NO: 8109 - DNA, 350 bp, Bacillus thuringiensis
gcagcctccacgctcctatcaacctgtcctgtcatctttggatctaacgagctcacgcgatggcgggtcaaacttggaggggggctacaagcataaatgcttgcaggacttatcccttccgcacatagctacaccagctaatgcccttgacagaacaaccggtacaccagcggtgcgttcataccggtccctgcgcactaaggccagttcctgtaaaatatcctacgcccacgagggctagggaccgaactgtactacgacgcgcatgaacccagctcgagtaccgttggaaggggctgactgaccaacccttgggaccgacatacaggcccagcatgcgatgagcccac

SEQ ID NO: 8110 - DNA, 122 bp, Bacillus thuringiensis
gtttgctggaattccagctgtccagacgattgcatttcatacaagtggttcatcgcggtcgtacacggggcgtttttctacatgagttgcgacatagccgcgtgaattgcccgcgcgttgct

SEQ ID NO: 8111 - DNA, 151 bp, Bacillus thuringiensis
taaaaaagcgttgcacttgccacggttttctatttatcataggtaaatttgtgggaagttgtcaccttcgttaacagcaccacacaaattcatgcccatccatgaacccattcaccatccccctcaatcaagaagtcaaataccttcttct

SEQ ID NO: 8112 - DNA, 529 bp, Bacillus thuringiensis
atcgcacagcttgagttccactgagaataataattcgtctcgcggcaataacgatgtggattgggaggatcattccactatcgtctccggtagggatgtgccctagatgtagagcatgacatgcttatagacatatcttgacacacctcaccatgccgcacaattgattggtacactttctgaagtatgaaaacggatatcaggctttccatcacaatatcatgattgtaatggctctggtatgcttttgttgggacaaactgaagttcgctgccccgttgttgtctatcccacgttcacaccttcgttcttgttactcagccgcgtttccagattctcccggtcgtgctttattcagaaaattgtttttggactagctgcgttatgttaggaccttgactgccctgattaatctggtagcaggtgaaaacatgagtgtaggccattgtccagccactgtaatgataccgccagctggagcagcgcttcttgtacaattgcgctacttacatacaaagatcgatatacg

SEQ ID NO: 8113 - DNA, 141 bp, Bacillus thuringiensis
taaacacacaaaaggttacatatactaacttataaccaactgctaacataccgatatgcttcgttattgctagcttatttcgattacttattggttttaaaccagttgcatcacctaaatcctaatcccagaactggtcaa

SEQ ID NO: 8114 - DNA, 366 bp, Bacillus thuringiensis
ttacaagcttctctgtataagcggaagatccagttaaccgaggggcacttgtacgttaaaagtcgaccgggacacaaccgctagggcgagcaagcgctgcatgtctggaaggccttaccgcgggaagaaagttaaaaagggttcctcatttctaaaacgtcaaaccgaataccacggcctctacggatgcggatccatgttagcgtgcacttggagccctggtatacaacagtccatgggcgcgtgtcatacataaatcagctactataggaggctaataggcaagaattggagcggacctaccaccaaatatggctgattatataacaactaccgatgcaaaagaaaaaagcattgcccggtgcc

SEQ ID NO: 8115 - DNA, 364 bp, Bacillus thuringiensis
acttcatcgttagtatgtgacagaccatccgggaaggtgtattactccttaaggagcgacagtaactcaaggcgatgtgggagaggcaccactgcccactactggtgagtgatagatggaccagccatcagctacttagtgtagggctcgctaacgcgtggtggcatgcctcttgcagaatgaacccatcagcgatcttcccttacgaggcttacgataagaagaagtgccgttgcccacgcgaatctgaatctactttagtggacagggccgctgaccagaaaccaggtcatgtaccgatgtcaagcatgaacgtccggcgactacagctgggtgcccaaactctatctcttatagcagtgcc

SEQ ID NO: 8116 - DNA, 220 bp, Bacillus thuringiensis
ccagaaatgtaatgggtcggtatgtcagatggctcccgcatgccatactggaatcttaaccacgtgctcaggcagccaaagcattattgcatctagctaattggcgcttaaaattagacccaaatgcattagttcgtcttataactgatgcataaaatatgttgggtcagcttttattttatatgcagccactggaaatatgagatatatttattaaagg

SEQ ID NO: 8117 - DNA, 238 bp, Bacillus thuringiensis
gcaggcaagcaagccgagccaactcagacagaaaaacctcattttacaaaaaaaggcccccccccgggggggggtaaataaaatacgcggccggtaacaacacacaaaagaccggcgccccagcccaaggcgcgaaacccacccacgccccacggcagaccagcaccacacccaccaaacaccccggacgcagacacaagacccacacagcaccacacaaaaaacacacgggggcccc

SEQ ID NO: 8118 - DNA, 486 bp, Bacillus thuringiensis
caccctccactcacagacctactcgcaaccgctcgcgcaacagctctcgcagcgtcgagtcgacgaaaccgactcgttctctgaaacctcgcgaccgtcagtttcgacggtcccggacctgtcaacctcaccggcaaaccggtacatcctgccatccagcccgcacgaggacgccaacccgcccttcacaagcacaagcgcaatgtacccgtccagcacaatcatggccccgtcaacgccaatgacgccggccgtatacggaatggacgactccaaacgtcctgccgacgcgcagccagtttacttctacccgcccgagtcgagcccgcacgccttcccggcgaccgcggccgtctcgtacccgacacatgcctacggcccctactctgatcccagcccgctggcggtcgtcgagcacccgcagctggattacatgggctatcacgccgtgcacccgtacctcgcacaccagaagaccaaccaata

SEQ ID NO: 8119 - DNA, 456 bp, Bacillus thuringiensis
caccgctcgatgatgtgatcgcattgggcgtttacttatggttggcaggattaccatcatttgaggagcatggagagccatagcaagagcatgttcttgcttggaacgacttgcgactgaataacatgcatgtgctataacaagtttgatagcttggggagctcttgctcatgcttgataaagcaatgcgagctcgcattgattaggttaactcagttttattaaacaatcttgggatgctctacatctatcaggccttttggctagatgctgccttatttactgatagagtgctacatgcatacatgcatggatagacccaacgtcttatcatgcaatctggtgtgcctactccatcggcctagagaacttgcgaaatgtcatcttggcttacaccgatgttgctgcgatagaggatccgggagttacaagaactaatgacagttagtttttttg

SEQ ID NO: 8120 - DNA, 182 bp, Bacillus thuringiensis
gccataatgtacacgactgtaaggcaggccactttagatgaacacaagcgacagatagaggataaaggtgcctaactgatgaaacatagactactgtaagaacaagattactcagatattcattatgttgaattaggaccacgtcttgaattataaaaggtatctaggggaagtgtactttt

SEQ ID NO: 8121 - DNA, 241 bp, Bacillus thuringiensis
atggagctccttgctttggctgggcttgtcttacgtagcggggtcggttactagatgatgacatatgagcatcagcgactggatccatcatgggtgatcgtcacggtcgtgtagctgatcatcttggtgcagatagctcagaacttaggacactactacgggctagtgctgctgcgcggaatatagacaggaagagtggaaatgcctatgaatcaaattttagcattctgcaatattagcg

SEQ ID NO: 8122 - DNA, 155 bp, Bacillus thuringiensis
cactactaattcatattttactcatcccaacagcagcgcgggggggtataatggtactggggcggcgaacacacactctatgtaaccttaaccaaacagtgcgcacgccaacattgcaaaccgaaagacggatgcagacgcgataccatacaggg

SEQ ID NO: 8123 - DNA, 105 bp, Bacillus thuringiensis
cgcgcgaagcgtaatttgacactgcaaacgaaacagcgcggggaatgtgtaaaggttcgggctgattagccagagcaccagcataaaaactggcggctcttccta

SEQ ID NO: 8124 - DNA, 475 bp, Bacillus thuringiensis
actgggcctgcagaggcgcccgatcagccgaacacgggcgtatttgggccgttcttacgtcggctctcccctcagcggcgagggcgcccgcgccggggggcatcctgtcaactgacaccacgcctctcccgccggccccgggctacaggccccccggggggggtgcgagtgacgaatgccgctgtggaggggccacatcgtctctggccgcgctgccgtcgattccatgcgcgtcgcctggctgggatgcgtcgggttgccccccgggtccgaggcgaaggggcgccgggcacgcccgtccggaaggaacacccgccgcgatgcagatatatattcctaccagcacccaccctgggttcacctccacctcgcctaccacgagggtgagggctctcgcgccggagggacctacgctacgctcgatcttccgggggggaccaccaggccctggcgcttggcgcccgaacaaaaaacg

SEQ ID NO: 8125 - DNA, 281 bp, Bacillus thuringiensis
cccaacaaacgagggggtaaaggatctagaaagggcgtcacatctagagtggattgatctacaaaaggaaatccatgggttaagaaggctctatattgatggcacgtcctataaagactgctatcaacttttaaggccaaggacctttcatgacaactttcgtcctataacacaatatggcttctttcttatactggggttcggtattaatgtctttttttcattctttatcacgcgcgaatgacttagaattctaatacaaaaccacccagcggaacgtt

SEQ ID NO: 8126 - DNA, 465 bp, Bacillus thuringiensis
gacgcgaatgtatgggatcacaattcgtgattgagactaaatgtaatcaactagccagctctaagaattcgggctgacgcaaaaatgagaaactgcaggggatttacgtgataaacaagcgtacatccgcgtgcttgggtatggatagttatcagttctacaagagtatgatgatctagcaacggacccgtaagaataagcgggaaccagacgtttagctaaagatagtagacttaaacgcgggattagtgacacgtcacactaacatcggtggacggaagatcaacagcataatacaagcttgttggccagcaactgtatacatagagagagtacctgtgctcggaacacttactatgttccatattcaaacgacgtttaataattgatgcgctggtggtcagcgttcgtggatagaatatgattacaatgcagtctagtctagaggacggcaaacatgtaaac

SEQ ID NO: 8127 - DNA, 258 bp, Bacillus thuringiensis
agacacaaccttgttaaccggtggcaacaaaaggtgcagggcgggtactctcacttgggcaggacctaccacttacagcacatggaactgcaagacggaatgtaccagactgcactaaagacaggaaagctacagctgcatcgcctgcactggcccgagaccgtaaaaaagcacactcatcgaccggtactgcactagcagcgcgggcaagactagcaagcggtgcagctcggccaattgtagtagtaatgcttgcac

SEQ ID NO: 8128 - DNA, 115 bp, Bacillus thuringiensis
aaagttttttttgcccaatgagctagctgactgagaggggtttatttgagctcactggccgttgtccaacgagaaaacctgttctgcacgctggattaatgtattacaccacgcg

SEQ ID NO: 8129 - DNA, 145 bp, Bacillus thuringiensis
tgacctaccacctcctttctattctaccgggccgtgcgctgggatggtggtttcaaaagcaactaacggctggatacaacgctctcacaagcgctaaggctttacccattaccattctctgttgatttcatttcaggtcctaatg

SEQ ID NO: 8130 - DNA, 488 bp, Bacillus thuringiensis
cgtagcaccagccactgctttattactaatgatgctcctggtacgtcctgttttcatgtgactgctctttcgtcacagatagctaataatatttagtctcctcaccccgggattcgggagaattctgtcgccttgtgccgaacggaagtgattcataatcggttctttgacgaacgattcctgatttctccgaggatagttctccagccttccaggagactgtaagagggcatgggaatgggcggatttatcagcaaaatggacaacagacaccggattacgggcggcggtagagaccaaatagtgcaagtattgcgtgattgtctgtggggatgacaaaatcgcaaaaaaaagcacgacatctcgatgccagatttctcaggcactcagtatacaaaaaggccgcgaaaatggcgttatcaactgccgatgatgtcgtgattgcccctgttctctcgatttcctatatcagagggttggtggcactt

SEQ ID NO: 8131 - DNA, 374 bp, Bacillus thuringiensis
gacgcgtactgatgggaaccgcattcgtgatagagcgttgccacttctattggtgggactagggtctgttatatggcaggcacgagccatctgttgaaaggacgattcctggggggactgaccaggagatcatgatgcaagcccacgttggatgtaatagtcagaggatgattgctacggcacgtgatgagacactggtactagactaaaccagataacttccttcacaaatggccatgaaggatcttcataggaaagaaggactgaattacggaacggaggtgattggatacgatcagacacatgaactgatcgttctgcatcatgagagtggatattattcgtagacgtagggatgaacattatggcaagct

SEQ ID NO: 8132 - DNA, 505 bp, Bacillus thuringiensis
tttcgatgatgtcattataatgagtagtcaattcattatattttaggttgtaatttagttttgaaagtttttgtctccgctgtttctacagttgctttttcgtggttatttttaacattagtaacgtagaaaattgtaccaaaaatgatgaaaatagaaataacaactgtccatttagtaaaaagtaatttctgcaatatgtaacgcctccaaaatttaaaaacttataattataatatataatataatgttgttttaagtagagaaaataggttagaaataattaaaattatttcttctctatacataaataattaaagttagtaaaatgtggaaagttatatgtgagaaagagggttttttagttgaaaatgaatagaaagaaaactagtttcaaggatttcaatggcttatgtatagttggtgtaattgcattcatattttatgaataagaatctaaaataaagggttttcagtaccaatggcagcaattcatattaacgat

SEQ ID NO: 8133 - DNA, 336 bp, Bacillus thuringiensis
agaacgccgagttcatgcacatgcgatatgggggggatggggttttgaatgtcccgagaaaggccggcttctacaagaacgcggcttgaaagctaccacaattcagagcggggggcgtgcacctacaccagtcacagctgccgccaatgctgtgctgcatgtagaagtgcatgaagcggacccagtatggaaaacactacaagaactacctgaacaagcaggtccgcacgagactaatacgcctgccgaactggaccgtggcagttgatgacgacatgaccggattagacttaatcctgacccccaacgcatatgagacactcacagcagccgaac

SEQ ID NO: 8134 - DNA, 144 bp, Bacillus thuringiensis
gctgttttttttaccgaatgagcaacctatctgaggggggttaaataaaactcacggccggccactcaaaaagcaaaaccgtcaaaccaactcaattattgtgtcagccaacccgcgaataagcaggaatgatagcattattgc

SEQ ID NO: 8135 - DNA, 114 bp, Bacillus thuringiensis
caagttttttttatcgaatgagcaagctgtctgaggggtgtttaattaagcccatggcctaccactaaaccagcaaaactgtgcggcacacacgatttttgttttttcccgcct

SEQ ID NO: 8136 - DNA, 135 bp, Bacillus thuringiensis
ggaattttgtttctcgaatgaactagctcccggacagaagacaaatttagccccttggcaagagtaatacccgcaaccctgttcggcactcaggctatctgtgttacactgcctgctcatcgtgtcgaaacagct

SEQ ID NO: 8137 - DNA, 398 bp, Bacillus thuringiensis
tttgataacgtgtcaaccacccaattgacgccacggataagggggggtatttctatcaagcggcctggctgttaaatgagtggtgacaaaagtgtctcgcactatagagacactgacaagtccattaaactcaagcgaagtgaacgcggattccatgcaaggacactagggttgtctgcgtgcgggatccgtctagcagaagcgggagctacatggacggtgaacacccacattatacaggaacgtagctacaccacactagcagtcatacggacagggacatgatgctgtcctaatgtctatgagccacaacggtttgacggagaactcagatgcacggagcgtatcacgattgtaaagctactcgagtttagttaaaagagcgcggaacgctttgc

SEQ ID NO: 8138 - DNA, 370 bp, Bacillus thuringiensis
  unsure (1)...(370): unsure at all n locations
catgcgggaatccagtaagaaatgaccgaaaagggtttcttcaagataaagatgcggtcaaacagcgggtcttatggttcaatatgatgctgatcattagcacgtctgggctatgcatgctatatattngatagaacggtgcggtggtactacattagcagaatacagtgtcagaattgtgtcggtctccatgggggatcactgtttagtgcagtacctcttattgcaaaactaactgatgatggtcatgccatattcacgcacgactgccttactgttgcggatgatgctaaatcatcgatcgacaccggtacagacatgctatatgcactaccttgtacatgtagaatgccatatttcactatgagtc

SEQ ID NO: 8139 - DNA, 295 bp, Bacillus thuringiensis
ccaaacattcatgttggagacggtatcctttaaaaggactgggctgctcttaaacatagaggctctttctctatgcacgatgaattttgttgtatgcagacagtgggatctatcacatattaaaggctcagggcttgaaatcgagcgaacgagcgtgtaacttgacttccaagcacaggcaccaggctatgcggacctataaatgatattattaaattcggaaaggcatcctcatacggggcaataaaataacaaacccgttacgaacgtgatgaaccgggctccataatgggct

SEQ ID NO: 8140 - DNA, 103 bp, Bacillus thuringiensis
gatagaaagcctgtttgggaatgatcgacgcgagagcggagcgagcaccttctatcaggcgaactattatagtcttatcaagactgaggagaaatcccctgga

SEQ ID NO: 8141 - DNA, 288 bp, Bacillus thuringiensis
tcaaatttatcttatggtccaccgtccaaatcaatatgtgcgataaagcgtggatggccaaacgatttatatcgggacagcattatctcaatgaattgctgtgggctaccacccattagagcatcacggaaatctattgcatttgctaattgctgtttcggagacccaccaccgtgcagtgtaagcattccagcattaaggcgagggtcatatgcactaagtgcagcttgggaatttttttggcgtataaaaacaaactggttgttccaactggtgaactagctgaat

SEQ ID NO: 8142 - DNA, 135 bp, Bacillus thuringiensis
gaaattttgtctatcccaggaacaagcccccccggggggggttaattaagaaaccgggcggtaacaacaacagaaacacagttcagcactcacgcattctgcataaccccacccaaccaactgagccaaacacca

SEQ ID NO: 8143 - DNA, 425 bp, Bacillus thuringiensis
ggaatcagttctgatcgcccactggcacttgccgacattgttatcacacatgcactaacagacagtcctatatcagctgcaccagtggcactgtaagcattgagggctgactataaccacaccttactagatatatcaaaagctagaatcccggctactttcatcgccagaatgctagcagcatgagacgctggcccgatgggacatgtaccaattgaggaccccgcatactcaaaacaagcaaaagagggcaacacccctctgcttgaatagaaaaaagaatttgtaggcgccaagggcgcaaaaagagcagtcatcccatccctaggaggaacctgccttgatggactggctggctcatttgaagcactgcgaccaggatggaccgcagacggcaggtgagccaggctttgcatgcccaacac

SEQ ID NO: 8144 - DNA, 186 bp, Bacillus thuringiensis
ggcaattagtctatcccaagaaaaaggccccagcggggggattaattaaaaaactgggcggtaacaacacgcgaaacacaaatagacactcacgctataggtgttacaccaccagcccctccgagaaaaccagccattgaccaaccgaacccacctggagcccatagaaaaccagacggcactcat

SEQ ID NO: 8145 - DNA, 204 bp, Bacillus thuringiensis
ctttggaacctggtatactcggagcacaagcactcagttgtgggaatgcgtagagaagagcgcgctgagatacgacagaacactcgtttgtgaatgcgtatacccggtcagaaactgacactgatacggaaacgcctgccgagtatacacaacaagaggcgctggagcctgtggctgtggacgatgggtggctcgagttcgagg

SEQ ID NO: 8146 - DNA, 232 bp, Bacillus thuringiensis
ggaagcatcatcgtaaataacatttaaggctgatttggaacctgagaatgacaaccttgggacggctttatcaatgctgggggcgaagcggccagaggcagaacaaatattggtccctttatgagctgaccaacacatgggcgcgttcatcttgttttcgcatatgagttgacacttgaccctatgcgtggcatcataacatcacttacaaatacatgtactcactgtcctt

SEQ ID NO: 8147 - DNA, 558 bp, Bacillus thuringiensis
gcgcctgccgcatatttgcggcgcgcccatcaacgccgttgcacccgctgctaccatcaccaacctcttgccatccaatctggccgcccccatcatggcggcgggggcgccagtcagcacggcgcaacatgtcgcccttgcagtcgcttattccgcaaccgcctcgcaagaaaactccgtggaaagctatgggaatgatggacccgagcagctcgggcccggtcggtggaatggccgcgtcattctcaccctgggagacaaggggaccgagcttgaagaaccgctggcagaacggagagcaggctgctttggggcctggaatacacagaagaccgcgtttcatcataagtggacggatatgcgattcggcggctggaaggaaggggaataaaactagtccaatctttatacgcatgaagcgcgccagtgacagggtcagcctaacgtcaagtagattgacgtgctagcgatgaactggcggaagccattgtcactgagattatgtacaagcctatcactatggatattcttacagtacattcacttcccagaaaaaaa

SEQ ID NO: 8148 - DNA, 134 bp, Bacillus thuringiensis
ggagttttgtttctccaatgaactacgccccggcggggggattgatttagaccctgggcggtagctacactcgaaacactgttcggcactcaagctatttgttttacaccgccagcgcgtggtgtcgagacagc

SEQ ID NO: 8149 - DNA, 134 bp, Bacillus thuringiensis
cttgctgggattggttgctaccacatgtacgatctttggaattttttaatttcaagatgtcttcttcagctatcttcggtgcttctagcattcccatacccaaaggatcgtttatatatgccctataatgaatc

SEQ ID NO: 8150 - DNA, 608 bp, Bacillus thuringiensis
  unsure (1)...(608): unsure at all n locations
gtatttatcgttgctgcatcgatacttaggacaaggacatcctgtagtccccattccagcatctatttctgtttataggcagtgatctcattggttgtattatggtccgttcagggacgtcgaagatcggcagttttacacgacaagaatacggagtagataagcactagtcggttagaataaataaagtgatgaaggctagctagaaagcaagcaaagtgagcccgcgttaacacgtaccatgaatagcaatattgaaatactacttcataagatactaacgtgatccatggctcttatgccatggcctgcatcatgcgggcgtgcctgcatgtgccgagtaggttggagctcgacactttgtccggcggccaaagctaaggatttctccggccccgattcgtcttcaccatggtcgacggcgaacaggcaggtatcccgcagatgatagggcagaatcgaaaagtaggtacatgagagtaaatagattatcaaccatgcagatattgctcctaaacgcctgtcataagagcgagattaaatacgtacatnctcagaaagcanaagcactggagttttaaaagagcgtgtgccgacaatgaccccct

SEQ ID NO: 8151 - DNA, 227 bp, Bacillus thuringiensis
ttaaaactcgattataattacactaacccggtaagccctgcggagggggaattagctgaagggggccgggatgcaatctacaagctcggttactctggtgaagaaacattaaatatgtatagctactcctagtacgcggagcgcaacgcattaaaggtcccaagtacccaacactgctgaatcaaagcggatatcgcaggaacacttccataacgtccaaaagcatg

SEQ ID NO: 8152 - DNA, 129 bp, Bacillus thuringiensis
caaaaaaacttctttttctccaaaaggccacccccccgggagggttttatataatttccggtcgggacacgcccaacacaaaaaaaaacccacgctacagtcataaccccacccgccccacccatcaaa

SEQ ID NO: 8153 - DNA, 106 bp, Bacillus thuringiensis
agcttgtttctgcgtgaaatagacattcgttcacattttcacacatcatactagccgcaagcattaagcgtatatcctggggttgcctaatgatgtgactaactta

SEQ ID NO: 8154 - DNA, 367 bp, Bacillus thuringiensis
tacttattttgtttaatctatttcttacgttagccccagtgctgtggccattactacttactcttatcgggaatggcatgaacgctagtgcaggatggtaaaagtgaatgaactaaaaagttgatatagggttttaagtatgtaagagaacgtgttttgataaattgaaaacacgttctttttttattttcatacattactttttctaatctgggcgtctaattttgaaagtaagtatttcgtaaggaatggataagaaaaaagagagatttattatataagatgaaagtgtagcttgaatcaatacgatatggatagaggagagaaccttattgaaaaatggacttcaataaaagtttgtatagtt

SEQ ID NO: 8155 - DNA, 157 bp, Bacillus thuringiensis
ggcaatccttctcgcccaggaaaaaggccccgggggggggtttaattaaaaaactggtcggtaaaaacacgcgaaacactaataggcactcaagcaatcggtgttaccccatccgctactcgcgtcaaaccagctattgaccacccggacccccctg

SEQ ID NO: 8156 - DNA, 156 bp, Bacillus thuringiensis
tcacccatttatatgattgatacataactcagtgacaacgggattgtacaaggtatgggagcaccaccttgaagtatagttacgacaaaaacggaactccgaagacaagaccatggatctcaaaaacatcaactcttaggaataaatccacaaaca

SEQ ID NO: 8157 - DNA, 375 bp, Bacillus thuringiensis
tttggcaactaaagcgcggtctcatctagcagtttgttttttacttctggttccccctgccccggtgctaggtttctcttgatatgttgtcgctcgagcagctcaaagtgcggtggtgtcttttgctcctactcccaggctacagaatgatggttttctttcacgtgttcttgtaaacactgctgtattcttacctgtaactggctcggtttaagtgcgtattattccaactcgtgtgggacgttagatgccggtatttctacccgcggcgcctggctatttagatgcttgtgcgctgctctttatcgtgactgaaaatacatcgacacgccctctttaacgttatcctggtggcggttttcattacacaaaacc

SEQ ID NO: 8158 - DNA, 126 bp, Bacillus thuringiensis
  unsure (1)...(126): unsure at all n locations
ttatcgtacagcttangtaacaacaagagagcacaggaataaggggggatttagatcactgtccccctactatcccccaaccatatgtgcttgccatttgcctatataaacataatgcttcaacta

SEQ ID NO: 8159 - DNA, 224 bp, Bacillus thuringiensis
tgttttcaccaaaaccacttaaagatttggaaatgtatcactgatggacaggaccacgttcgagcatcatacaaatgaatcacctgaagcattcctcccgttcactacgaggagaactaaaaaaaactgactacccttgtcagttcatgcaacgaacagctgatcatatcaaaataacagctactgggctggaaccagtccatggttaaatgtaaatgaagaga

SEQ ID NO: 8160 - DNA, 393 bp, Bacillus thuringiensis
acgtacagaaaaaacgtaacacccggtatgtttttacataaacctaccaaactctacatagggtgtctgaaaaccggattctacagaattatgatacacagcccagacgtgttcatgctgcctctacaagcgagcgattgcatagacatactgaccggaaataatagatgaggtctactggaacgctatcatggtatatgtactgcagtgctatccccttgatactgggacttgttgaccaccgaaaaaaatggtgctatggacacacacatatgggcgctcacctacatatgatgctggttgagtgactgctaggaggtgttgtacagcgacaaacttatgcgtgattatttggatcatgttaccagctgtgtatgctgtggatgctcgtag

SEQ ID NO: 8161 - DNA, 211 bp, Bacillus thuringiensis
tggagaggctggcccccaaatcaagataccgataactctatccggtcctgagggtaaacaaggtttggggcgcggcgcagggcaaataaggctggccccctcggaagcggaaaaaccagccggggcaaacccaaggggtaaagcccaaaggtggggccccgaagctcgcccaaagggacctattgaaaaagcgggccacgaaataaggtgg

SEQ ID NO: 8162 - DNA, 295 bp, Bacillus thuringiensis
ccaacaactaaccttgacctacatgcttttattattggtctatgcatgcggtcgctgatggtgcgataacagatactagctgtgtatttaaatcaacagcggacactttaacggatttacaatcatgtgctttcatcaatgaagatacatctaatgcttcattaaaaacatcctttactgtctgccgcataattgcaccggccattctgtgagaacctacttgcccacaaacaataaaggttggctgaatattattattcacactgcacgacccttggctaagaggtctaacccg

SEQ ID NO: 8163 - DNA, 219 bp, Bacillus thuringiensis
atgcataagtttttcagggttaaccatcgtatcaatatttcggactatcctttttactcaaatacacacgaaagaacatttcgccaccatatgtatcctttgctatactaactgccggtcaaccatgggcactacaattccgccagaaggatacgagaagttcaacggcgggcctcctgataaaacattggcattgcgaccgtacggatcaaattcttt

SEQ ID NO: 8164 - DNA, 483 bp, Bacillus thuringiensis
atatattggtatcactgacttctggcaaagtataaatattactaggcaggtcacttaacagaggcgggttgtgatcacattccaaacactctatcagataaccagcaatactgagctctttcgcatgaatagcacgtttcgccataacagaagacatatcttcattcattgctatatggtttgctttggttaccttgtgctgtgaataaggaaacgtttataggacatctagctcttttgcttcatcataagcacgatgcctaacctctgtatcttcatgagccatcccccttaataaaccatctatatacgcttccatctgctgggctcccgacaaaatcaaatctgtctctttgcatgcgatatacgatagactactatttcaacagaagaaagaggacgccacagcatcctatacttctattgtctattccacacaagtaaactgtgatccagctgctacatgatctaggaagaataact

SEQ ID NO: 8165 - DNA, 578 bp, Bacillus thuringiensis
  unsure (1)...(578): unsure at all n locations
acgcctgaaggttaatcagcgtcatcatcactgtcgctgttcatctgatctagcatgagatcaatttcatcctcagttcgagtctcgacggtcccagtaaggccagactgtctgtcggattgggtgccattaagtgagccgtgccacttcacgctctgcgaagcgctatcatctatattcctgacatcttgattgcgctgagaattctgggagtttgaatggtacccggatgttcctgggctagacatgaaaagcaaggtctcgatagcatcttgctccattgaggagctctgcgaattatcagaccatccgtgaaaagggataccgttatcgttagacggacaaagcggcggtgtttcgggcactcgggtgacctccgtgtcagccacaagctcctgttgcgagcggccacgtctatggagagggaaaggtgcataacgtgaagggttgctaggattgttcgggtttgggcgacgtcgttggcggttcacacgacctgngtcaatgtccgctggtggngccagccgtggaggccgcagctctggatgatactctgcatgtttggtcagatctggctg

SEQ ID NO: 8166 - DNA, 415 bp, Bacillus thuringiensis
gatcccgagtttactacacccgctcctccattacgaaacgctttgctttttgccttatacaagcaggcatcagaccggggatgttattgaagtggttgcggtgctgctttgaacagaccagtgctcggtgcgttttatccatacgtagtaaggcacgccgtttcagccaaagatcccctaccatcactttatcgagcaactgcaccattgtcattccctccagttacactcgctcacggacttgcggcccgtcgtgcccaactaggaatggggccagctgcttctggtgaactagaaaatggtttgatggctgtacagctaacaaacctgccagttgcgttaatccctactacagaagattgttcggcgcggctcacaattgaagcagcggattctggcccagcagatactactg

SEQ ID NO: 8167 - DNA, 122 bp, Bacillus thuringiensis
gggacggttcccttaataaccggcctctaggtccgttttaattagctctaaatggatggttccagggtcatcaattgggacctacctttccctgaaccgggcgtaatattttcgttttcaaa

SEQ ID NO: 8168 - DNA, 242 bp, Bacillus thuringiensis
agaaaaacttctttttcctgaataagggcacttccctgggggggttttataagcttcacggccgtaacaagccaaagactaaccgtcgctcaagctattggcgttataccatccactcctatcttcagaccagcttcttaccaatcgatgctcaccttagaggttacaaaactcgacaggaccattaatagaccacctgacggcccctgttagttcgatagggcactcgcctattactaccc

SEQ ID NO: 8169 - DNA, 593 bp, Bacillus thuringiensis
tggttctggacggcgtcgtagatgcggaagactactacagcctcgggtgaaggtccaatctctacgacgcagacaaggcactccattcattcatcgagtcatgttttcaagctgggggaaaggaacgctacgcattctggggcccgtctgtacacgacatcagatcccaactcgacgccctcttgcaaaacctgaaatacaaccctattcccattccaccgagcgttactacctgtcttttaccaatgctagcaacctattccgatctcagttcatctttcaagccatgtacataccggccgagagattacccaaactcgcagctatcctggctggcctagaacagagcaatacgactgcctacgccatcgcagtgaccggcggcaccatccctgcaagcccgtgcaactatgccccgagcacggcgacaagggacgtcgacactctgaaaaaatgtgtggacggtgccggtgaaaagcggttcaggagcattagccagtttgaggactatggggatgtcctaacgtcgcacagcgagttctttcgcgaggtctggccaaataacgctaatggtgtcgcttgcagagcttttg

SEQ ID NO: 8170 - DNA, 110 bp, Bacillus thuringiensis
gaagctttgcttattctgataccaggtggcaaaactaacattccaggttaggccgaaaccaaattcaatcttactctttctatacacggtggggcataagtttctaaagg

SEQ ID NO: 8171 - DNA, 161 bp, Bacillus thuringiensis
gaatcggatgacataggtgaaagggactattgttatttttaaagataccatctcattcaatattgggactgatcgaataaatgccggactgtcataagatttattttattgggagctacttggagatgttgatgcggctacttattctgaggagagacaac

SEQ ID NO: 8172 - DNA, 275 bp, Bacillus thuringiensis
tttagcaccaacactgcacctcccccagggggatctgtaagagcaaacacaatagaattagcgacagtattaacaacccatctcgccatgtctgaaccatctatgcaatacacccgaagacaatatgaaacgccggtgcctgagaacgacataatactgctaaaccgtgacatagtgacacacctcgaccccgccatccaaaatcagacgaatgaagggcagggattataagctgacaaaaaaagtccacacatttatataaagatctaaggccc

SEQ ID NO: 8173 - DNA, 264 bp, Bacillus thuringiensis
ttcgtgaacggtgaaactatccgttgacgtaagccaccaacaggctcctctgtgggaccaagcaagaccatgcagaaaaagatttggaaccgattaccgaatgtccccaatactattagacgatagaaagaaagagcacagagggggaactgcttataaaataagagaatcttccgaagcatgcctcggtagcggacatgctgtatgagcagaggccgtttaatagttcctggacccatagcagcaagtaacgaaaaaccgtat

SEQ ID NO: 8174 - DNA, 126 bp, Bacillus thuringiensis
cacgtcttgtgtctccaatgcgctccgcgcctggggggggtttatttccgcccccttcctgtcgtgacccgcgcaagactgttgggcactcacgatctctgttgttctccgcgcgcgattggtgtc

SEQ ID NO: 8175 - DNA, 119 bp, Bacillus thuringiensis
tcgtgatccgtctaactgtaccattgggcgtagttctggcagcctgactggtagatcatataagatcgcgcaaggctgttgataaacagagcgacggattgctgctaatacagctagac

SEQ ID NO: 8176 - DNA, 214 bp, Bacillus thuringiensis
ggggggattttaaaaagaaacgcgggtttaaccccggactatccagcatatagtctctctacgaatctaagacatgcgatataaagtaaccaaacggacagtaccgatgatggtaccgaccaacacacacgcccttcagacttaagtcctcgtacttgtttcgccttgaaggtgatgagttacttccgcctatatctaaccttacaatcgattc

SEQ ID NO: 8177 - DNA, 281 bp, Bacillus thuringiensis
atcggatcccgcaagtgcgtgattattcacacttggggcgaggcagaaaataaccctcgtaatcatcatcatttactaaagtcacctacgggacttttaacatttcatacgaggagaataaaacgagaacgtcgacttttgcggcttttgctattttaggcatacgatgcgctacagaatacgctatcggtacactcattattttgcttaatagatggtacaccctatgaaaccatacaccagatctgtttacctgaacaatactcctttgggaaggactg

SEQ ID NO: 8178 - DNA, 155 bp, Bacillus thuringiensis
tatatcatgaattctattttgaagcgactcaccattacaatactggggggaatattgatccacgtggataacttgattgaaaagtacgaacactcggattttaccctttgtcgattgcagttgcatattaccttctttagcatttaattaacaac

SEQ ID NO: 8179 - DNA, 427 bp, Bacillus thuringiensis
taggaaagccctgctctttacggcagttatatttccaatcaaccccacatttcctaacttgggccgtttttttttaattggcggaaaaaataattacctcaggtggaaaggatcctagatctttaaaactatctcccttacttttttctccaacacaaataggggttggtcccaggcccctcatcctccttggtttaaaagaaatcaaccttggttggattttctcctatcctaatcagaccgttgaggggatgtttccatcagggccccgtcctttttaaggacgcttacaaagttggctgccggattcggcctttgagagtcgccctactttaaacctggaaagatccccccctggggcctacgcccaaatgggttcctccgttccttataatgggactcagggttcacaaaaaaaggttttcgg

SEQ ID NO: 8180 - DNA, 299 bp, Bacillus thuringiensis
ataacgcacgatctgatgccaaataaataacacgcgatctacaaaacgcaaactgtgatgctttcgtgagtgtttgacatcttatcgcggatcatcctaacttatggaagaaaaataataggaagccagattatgcaaatgtaaaacgcaaccctggcgaaaaagtaagcattctgtatagtggtgtcttaaaatacaagggttgtatctggcgcttgaagacccactcctggtacacccgaactatgagctgactggactatcattaagccgataataacgatacatggctgcaaaga

SEQ ID NO: 8181 - DNA, 281 bp, Bacillus thuringiensis
tatctgaattacaatggctcagcgttccttactttacacaacggttgggattgaataatattgcgggggaagatgaacgggtcatgcgagcgttaaatgaaacttttaatgtttgggcgctcccccgacaaagttggaaacttatctggtaaaacatcttctgttttactggatcctgatgatacagactccaatattttaagtgagagatatccagcccttacgttatatcaatgtcatggttcccctgtaaatggattggcaattggattaagtttaga

SEQ ID NO: 8182 - DNA, 399 bp, Bacillus thuringiensis
cagatttatgctagccatgttcaagccacctgttgttcacaccaggagcaacaatggaagggcgtgcgttatggatactcttatttgtgaagaggtcaccacctgcatcatgtacagaaccgactagtgctgcgcaagtatctcgtgagtgctcaattcatttaacaccaactacagctttctctagcactacttcaattacagcttctaggccacgtaaggttatcatatctacagaccacgccagagatatgggaacctactacttcgacacgatatgggaactctaactcaaatgcaagagcgagaagagttgaaacagcgagcgtgatctatcaacatattaatagacacgtgtatggaatgaagaatcatcggatactccacgagttcactttg

SEQ ID NO: 8183 - DNA, 125 bp, Bacillus thuringiensis
cggagttaaataattaccaacgcgcaactggcttcaggagggtctttagaaagtcccacaaataagctcctaacgtctatactctataacccctcttatacaacgagtgcacttactcactattt

SEQ ID NO: 8184 - DNA, 347 bp, Bacillus thuringiensis
  unsure (1)...(347): unsure at all n locations
aacgaggcgaaaaanngggggacgaaaggagaaaagacgcgctccatcacccaccaacgagaccaaacagcacaccaccatgaacagtaaaacataccccaccaacagctgatacacgcccaaatgggcaactaaaaacgccacccagaaaaggaaaaaacgcccacagggcccacacccctaaaaatgggacacacatggacccgcacgcaccccacaaaaccaacaagcgacaccaagatcgtcaacacaccacacccaagacccggggccacaaacccacaaacagccaaacaaagcctcacaacgccccaccaaagaaacaaaacccaccgaaaccaacaaaa

SEQ ID NO: 8185 - DNA, 362 bp, Bacillus thuringiensis
tgatgtatcgcttatctctcttacatgttcatccaacctcataattactgcatcttcccatgccttacggggggattttaaaactgatacgggggttgctacattatctaattggtcatcagatgctaccatctcataccaccattcttccaccaaacaaaatccaccaccattttccttaactttccgcaagacttacactgcacaattaaactctcgaatgacttccctttgtgagtataccaatctaacgtaaatgctttcaatctccttcttataaaccatgtgaactcccccttacttagctcctagtataaaaaacgcctattgaacttaatatctataaaacgactatacggaaa

SEQ ID NO: 8186 - DNA, 141 bp, Bacillus thuringiensis
atcaaccggaagatacaggggcgggtccatgggaaatatgcggaggtctcccagaaagaaagcttaaatgcattcatggcacgagcacattgatgcctacatatttgcaaaaaaagctgatgaatcttcgaaacctaaagt

SEQ ID NO: 8187 - DNA, 151 bp, Bacillus thuringiensis
ctacaccacaccgtcgggcgcccccatctcgctaacgttatattctatctagccaccctaaaggccgcacaatctactggaacctgatgcacaccgtggacactggaaaaaccctggcgtcacccctctgacccgcctagtaacacatccc

SEQ ID NO: 8188 - DNA, 302 bp, Bacillus thuringiensis
cggaaaagaaggtggtgttacttttaagaagtgtaagaacctctaaaagaagttgaaggatcaaagaagagtgaaggaaccgtaaaagatgatgaaggatcgaaagaagaagtgaaagatcctgcataagaagttgaagagccaaaagaagaagtggacgagcttacaacaggagttgatgagtcgaaagcggatgggaaagaaacaggaaaagaaattgtaggttcaaaagaagcagtaaatccatccgaagtagtccaagaacaaaacatgaatcatcaagttgtgaaagaaaataaacc

SEQ ID NO: 8189 - DNA, 247 bp, Bacillus thuringiensis
gagatgagcactgtgctgtttcaaaatgaactgtaattttttcgagaaatggagacctacacttttcatgtcttattaaagggaacattggtttttcaatactatctattatgcctgtgaagttaccattatatagactgtatgtgggaagtggggcaaatcttccgaaaaatgacattctatacaaaatatgcatcactttagtagcgcaccatgagacgcgcatacagaccttgtccttacatgt

SEQ ID NO: 8190 - DNA, 381 bp, Bacillus thuringiensis
cgagatacgagcatagaacgatatctagactcaacgggtttttcggcctagttggcttgaaatacgcgggggcagtatgtacaccttggcgctttcaacagtctttgatgttgattctggaagatagagtactgtccagttatgcggaacttgattacactctatacacgcgcaatatctaagcggtctgctaaaaaaaattcatactattcattataaaccaaagttgcacatatctgctacagaaaaaacgggatacttttatagggtagcaaaattataacatggctgcaccttattcttgaagcatgagaacccgttgctagacatacataattagcattatagtctcttattggagcgtatgcaggatttgctgcg

SEQ ID NO: 8191 - DNA, 293 bp, Bacillus thuringiensis
ttgttcttttgtcttatagatctcggtggatattacggagaatatcacacccatatcgacaagcttacttacgtaacgatgtgaatttgttgccttatgtgggaatatgaagcgacctgtatatccaacgattctgataataaaggtgacgccgattgtttcgacattattaatctttgatgtgtaacatagatatatatctcattaatgatataagtagtagaacatgatgaatggtatgctgatggtacacatgcagaaggggcggcgtttgaatgatgacctattcgaaa

SEQ ID NO: 8192 - DNA, 200 bp, Bacillus thuringiensis
atttcaaatacttagcgaagaaaagttgagaaaataattctctaactattccttgcatacttaatttatgtttagaaataaaaaacttgttttccaattatatgagattaaaatctaaacgattaaatctaatgaaatagatctttttaattacatacttaatttattttctaatgtccaaatatttttttctcccatta

SEQ ID NO: 8193 - DNA, 293 bp, Bacillus thuringiensis
accgaagatggtttatacaagcccggtattatcttataaagcgttggttttcctgcaccgatgggggccacaagcataacgaggggcgccactccaatttccgaagtaatattaacatctccagctttaagccacacccatctcatgctttacgcttgctgttgaaaccgatcccattaacacaagctacaatggtatctggtggaggaagacttaaaaagcaaaaagctctatgtgtcccagcgacagcaacttggggcattataaaagaaacccccacataacggacaggg

SEQ ID NO: 8194 - DNA, 153 bp, Bacillus thuringiensis
gttcctaagattcgttaacctttcgaaatccccatgtccaagtggactcacaggcgtattgggggggtccattaaagctcctaaaggggcatttctttatccgacggttttatacactgcaaattgattcaatctcacccggttcattcactc

SEQ ID NO: 8195 - DNA, 348 bp, Bacillus thuringiensis
gtaggaatgcacatacaggttctaggtgagtctcacttacaataggcgcgaaacaatcagatcgaaaggggaatgtactatactgctctgtaattataagctacagtcgtctgaaggtgcgttaactttcacttaatgaatgatcgtacatataacataggatctacacacgtatggcgtgaatctacaaactgatacccgatcatagcttattgatgacatctctatgtaggcatctaaatgtacaatacacgcactttatcagtcaagacatagagagcgcgcggtacaactgcttcgctcatgtgttcataacaacttttccaacggcatcgctaccagtcccga

SEQ ID NO: 8196 - DNA, 226 bp, Bacillus thuringiensis
tgcgtatttagtgtcgttagtttcgaatcataaaagtggaggacagattaccaaatccgacactctaccatcagtataggcccatattccgacgtaacattgcctgtctctatgccatttatcgtgttgaaccttaccatgggcacaaattgatcttcagcacataaacgattaaaaaactttgatacgacgacgtaaacaaagcaatttaaggttttacaaatga

SEQ ID NO: 8197 - DNA, 204 bp, Bacillus thuringiensis
agacgcgttaccgatacgaatcagatcccgaagatcgtgactagattgaagagatgcagttgttaaagcattataatgtatatgtatgacgggaagaatagtaaagaagcgagagatgactcggcgctggcaccacatcgatgcattacagcagtttcagctaggacgagtcaaaaataagagaaagcctatttccttttaagg

SEQ ID NO: 8198 - DNA, 224 bp, Bacillus thuringiensis
ttcgatacttacatttgcaatataaacacccttatattgaatggtacacgcccttctaatacgggagatttataaagagtgggggttttaacatcttgccgattcaaaaacctgcccgattccgggtgatcagaaactgaattggcccgcattcttaatgaaactatgaactccttttgtaccgtctttaaacttagcatcaacctctgctggctctttatttg

SEQ ID NO: 8199 - DNA, 244 bp, Bacillus thuringiensis
gacgcgattcgtagcgaatcacgaggtcgtgatgtccgtcagcgatatttttaagccagatcatcgcttttcataccggatacacgaacttattaccgggccaaatacaacgaatgacgtgttacacaatgactctgcgaagggttactacgccttcgatgagaaacttcatacccaatacatgttgaattcaatactcccgctacaggcgagaagacctcctatatacaacaagccatccgcc

SEQ ID NO: 8200 - DNA, 261 bp, Bacillus thuringiensis
ttcgtgatggctcactctaacgctcaataatcaggcaccattgtatcaaccataactattcaaaagccagtgggattatttacaacaaagaggtgcagcacccttactctccaaatctccttatgacagaacaacactatcatttagttcaaccattaagcgaattcttactatcccagcttctagtatacgatacgctctcaataaacactctgattgaccactaccactgccaacagacccattaaacacattatatat

SEQ ID NO: 8201 - DNA, 385 bp, Bacillus thuringiensis
tacttactaaatgtattagtgatatgacttttttagcatatgcaacgcaagacctcatggaccaatagtgacgcacggaatgtttatatttactggtgtaatcttcactataaggacttcgatatatacagaggcttatatggaacgctgacacattaaatacagtgttgcagcaatatatgcccgcctacattcgttacatgctgcggattcataaaaggcgaagcgcttattgcttacgcaatagaatatgctcaataactacatatgaatctaatgactatggtacacttaggaagtgaggagtttgaccatttatcgaatagaaagccaaaaggcaaggtatcagtacaaatattagtattatagtcccaaaaaagatctt

SEQ ID NO: 8202 - DNA, 349 bp, Bacillus thuringiensis
aggttgagttattatgtcccttatattagcaggttatttaagagggactttcgcattggtcaacaatcctcaaaccatattaacaaattggtatactactcctattacacatgtttttcagttatcatatcctaactcatcaatacaagaaattaatgatacgttttgcagagagaataaatgttattgcattttataataagataggctatgtaccgtcaatttattactcgcaaaatatagcatcttgattttgatatgaaaaatcatttggagcctcttataacttggttacaagatattagcaaggatagactgctgtaaataaagttaaaattagatatatatt

SEQ ID NO: 8203 - DNA, 166 bp, Bacillus thuringiensis
ccgttacttttttctaaaggaatggaattagaagtgggtgaatttcaaaattacgcggggcccaatacaaactaagtcggataacgaattagatgcaaacatatttttcagcccattccaatatttagacaaagcacattaaagttccgtatatatgtttattgaa

SEQ ID NO: 8204 - DNA, 175 bp, Bacillus thuringiensis
gacgcgtttgtatgggatacccaagtcgtgatagacccgctgaaactgccttgggagtatgcacgatttatatagtttagtgcgactggaactggtcgtatgtattacaagcggaatgtatcacgcatcatggcaagacagatattgatgacgcccttactgatgcatacataca

SEQ ID NO: 8205 - DNA, 1326 bp, Bacillus thuringiensis
  unsure (1)...(1326): unsure at all n locations
ataaaaaatatatatataaaatatatataataattaaaatataattattaaattaattatataaattatgtttatatataaaataatataaatatataatgataatataaatataatattattaaataaattataatattatatatatttattttatattaatattataattataattaaattaatatttaatataatatatataatataatattaaataatttattaatataatataattataataatttaattaaatataaataatattaattattaataaaattatataaataattaaatatttaatataataatattattataaatattaattaaaataatatataatataaatcataaataatattttaataatattaattataatatattacatattttatatataaataatatattataataataataataatatatgttaataataataatataatatattataagaattaaatatatatatacagtgatatataatataaaatatataataatattatattataaatatatataattatattatatatatataataatataataatttaatataaaattaaatataaattaaatatttaattatatattataaattactatatatatattaatttaaaaatattataattataatttataaataagataaatataataatattaaatataattattatataaaatatattttatataaataaataattatttaattaaatatatattataatatattataaaataatgatataaaaatattcatttattaaataataataatatttatattatatataaatataaaataatttattaataaaaatataatataattataattataaataaaattaattaatatatatataaattataaaaattaaattatataaattattataattatatatatatatattaattataaattataattattaatataaatattaaatatagtaataataaaaaaaataataattatatataatattatttaaaatattaatataaaattaaataataattaaatatataataaatattaatatataaataaattttaatatattatttatataaaaatataataattgattatattaaagtatataatataagatatgttaaaaaataataattatataataataataaatatatatatataatatattaaatataaataaatataatatatttatatatntatattatatataaattattatttaataattaatatagataataatattaatatattataatatatatataattattttaaatata

SEQ ID NO: 8206 - DNA, 112 bp, Bacillus thuringiensis
acacatgatgcgtaacacaagatgttttttaagtaacgactgcttcaaaaaaattggttactgctaagagagagagggatggaagaagctgactacctgcacgatctacata

SEQ ID NO: 8207 - DNA, 220 bp, Bacillus thuringiensis
catcattcattcttatttatttacatgaattgtaggaacgggtgttcttatgaaattagcgatgattatgccgccgaatcaaaagatgagtacgtatcataggggcccattctatgcaaaaggaacaaggattaatatgactagatgttggtagtaacagtcggtgatagagatataaatacaattgaagatcttggaacgagaaacaacatggtacatg

SEQ ID NO: 8208 - DNA, 235 bp, Bacillus thuringiensis
gattatatgttgcattccaaatggcaggtttgatctttcggaacaccgctaaattctggggggagtaatctagttgtgcgagtgttcaaggttgcccctattaaatggcatcactaggatttggactaactacttcatatgtcagagttccaatcaccttcggaattataattggatttacaaacttatgatccacaccataattctacaggtaaaatagcaaaaagggagggct

SEQ ID NO: 8209 - DNA, 130 bp, Bacillus thuringiensis
tttaatatagtgacatggaaagaagggtaaaaggctagctgaagtttgcattaaaagggcaagagacagaaagtatgcctacttgtatggagcgaaagccggcaaaaaaggatccgcgaccaaatgccaa

SEQ ID NO: 8210 - DNA, 173 bp, Bacillus thuringiensis
ggaacactcgccaaaggggggctattgaaaacagagttccatgcatataacaaattatctattttttgggataatatgccttttgaacttcctagttcacagcaccctaaacaaggaatgatctgcctgaaaatatccttatgggccatatgacgaatctgctgaaacatata

SEQ ID NO: 8211 - DNA, 484 bp, Bacillus thuringiensis
cgtgataaatggccaaacgttgttaatgctcctgcactttgttttccaaaaaacattgcagatgctcagggggcactatgaggcttacgaagggcaccataacattgtcacactatgcgaacggtagctgcaacgcttgcgatggagggtgtcatacaacttcagactatatatatcgaacaagagcgtttaggcctccaacttaagacgattagtgaggatgtaggtttccaacgctgttatacgaaaattactgggcttgcacggtctctatattgacaacaagaggattgggacaacgctatcttactagctgttcaagaaggtatgcgaacacaatcattacacttgttggaaaacattgtacattacatacaccaatgactttcataaaaaattccgactgaatattatatgagaattccaaagctctaaatgctgttgatcaagctcattttaaagagcctggtatagctctttggaa

SEQ ID NO: 8212 - DNA, 559 bp, Bacillus thuringiensis
  unsure (1)...(559): unsure at all n locations
aaacaaatgatatttttgttagcaataaaatattaatgaacaataacgcaaatccaagtaataccgccaaataattttgttctctaaaaaactttcttaacttatctctttttcttatatttattttctccaatgaaaccacctcttcgaatgatgaaaagcccttattcagggctcttcatcataatctatatatctatttctttgcagctttcactacaaatgatacaataaaaattaacacgattgcacctaataatgctggcacgacgtgaatcccaccaaatgatggcccaaaggagccaaataatctaccacctaacgaagcacctaataaacctgcgataatatttccgaacataccacctgggaaatttttacctgttatagaactagccattgcacctataatagcaccaactattaatgtgataatccaccccatnnttagtcctccatttctattataggttgtatgatttaatccaacatatgttttatcattgctaaccatatttcactatagaaatatatttactactattntacatatggagat

SEQ ID NO: 8213 - DNA, 361 bp, Bacillus thuringiensis
tgatagtgattttaagtatgacctctcgtgcctagtcatcgcttccctcctagctcatatctgtcgggtggactatccgcatctctccaggggaaaaaaccatataaaattttctaatactatcgccttacatactccatcagtgcaaaatatcccgtttaaagtaacataataatatgtgccataaaaagcactcgatataccgttgcaattactaactggtagctcaaccatatctttaattagcttgctcgccttattataccggattgccttttaagtatgctctatgtcaagcacttgcatttcaactaaatacgcactcatgatctgactctcctttgcttttaaataacgccat

SEQ ID NO: 8214 - DNA, 412 bp, Bacillus thuringiensis
atacactgaggatgcctttctaaaactttgaatgtttctgatgactgatgcagtaatatatgccggggttcttaaaccacttgaggggttcgtgacctgaggggttacgcttgttcgacatattctctttgacattggtgcacaagattatgcagttgtactattacgtgcttatatggatcgttgcgatcatgattgcacagtgcaggtttatgaacatcatgtatttgagagggatgatgtgtaagcgtatctcatataaatggtagaaatgatgaacattgaccaggtggagcaccaaatataagctaacccgctgtagagatataatcaacctcgggcggatccgcttaattactaagctcaaatgtctggaatgcatcttgaagtaacggattttattgatgaattg

SEQ ID NO: 8215 - DNA, 153 bp, Bacillus thuringiensis
ttccatacactatttcaccaaactatgcccgatgtctcattcctatacagcttaccatatgagtgcgatttttaaaacccggcataccgttaatacccgtttacacggaaacttctcctaaatatttaacctaaccggccgatgaattattag

SEQ ID NO: 8216 - DNA, 221 bp, Bacillus thuringiensis
attttctttatttcgctcaatatgtgcattcactttttcaacaattccttctacttccacgctcgatgactcttgtaactcattaaagatcgataccgtgctgtcatcagcgattaaatcttggatcgtccgtgtgcactaacagctccatatctttttcatactacgaacagcatcccgataatgaatgcattttagagatgtgcattgactgcatttaa

SEQ ID NO: 8217 - DNA, 251 bp, Bacillus thuringiensis
tcttgcggtcaggtggcattggactttttttttgatggtacagactcaactattgcgttgcataccttaatgatgcttgttgcaattcaactccaatcaatgcatgtagtacagctaccgctactccacgtatcgctcgcccagcactcagtgccagacgaacgacttactgaaaattcttcaaatgcttctcaagcttcaaaaggccatggtatggtttcaatcggatttggataatgtgcaccagctac

SEQ ID NO: 8218 - DNA, 443 bp, Bacillus thuringiensis
gaagctaaaactctggcgtttgtgaccggtaacaagccttaccttacgtgccagcgtagtacgaaacctataccctagactttagtattaagagaccatttgacgataacgttataaggcgatgctggggaatactaaaatagactatgcaccctctttgtagctgcattctcgctgttcatgcagcggttgaccgcatagcgaggggttcagttcggtatggcatactgtaagcggctgtctctaacgggacaataattgttcggatgagaggcgggcccacatgctgtgaacctgtttatagattgattacaccaagcacggtcattaccatcgatgcagctcgtgttgcttcaacagctcctagtacaccgagggtatcctttgctatggcagttacagagaaaaatgtcagtcgtgcactaacaccggagcattgtgct

SEQ ID NO: 8219 - DNA, 410 bp, Bacillus thuringiensis
aagcgcctatatttccatcttgtgtcacagggggaaacggatcatgtgtggcaatagaagatgggacgcttggaagaagctatgatgcttcatgggatgtgctcacccgatactgggggtagcaagaggactgttgtaatgtgagagacagagagacacttggaaaaagttctagtgcgcacataatactaataactggtgcttcgagatcatagctgagtgcaacagctgtgacaaaggattctacgtcacgatatccagccattattgataaaaactgttgattctatgctgaaaatggtttatatgcaccggaattatagggttggtcattagaacggcctgtttcaggcatgaatgcatcccgaccctatacgttgcgttcttatggatcgtatggagaaaaggaa

SEQ ID NO: 8220 - DNA, 406 bp, Bacillus thuringiensis
agaattcgtgacttattgcagatttttgtaatgaacagtgtggtcatactcgatcccatctgaatcatagggggtattatcgtctgaggggggcgtatcaccataagtagtattttttgacactttaaataaatctatctatgggttttggtttccaatacaatcaacatatgatcgatcatccttgggcataaccggctcttctgcatcttctacaaatacaagccacctctcatttgatagaaccggcttggaatttaccattctttgtttatctgcaaggttaaattttaacagttcttaactgctacaaaaatgagcagggttatctgatccacggaagatgctgatactgacacctttagttgcacaattagtttctcaagcgatagttaatctgtaacct

SEQ ID NO: 8221 - DNA, 271 bp, Bacillus thuringiensis
  unsure (1)...(271): unsure at all n locations
aaacagagcngacgagaaaacaaaaagcagcaggccacgaccgagaagcgcgaacaacacaaaaaggaagcacgctcaaccaatgaaggaaatgctattggccctaataagattgtaacatgtaataccgatccataaaaggaataacgcgaactcggctcaaatacagttgaatatcacaatgctcatatgacatacgaatcacgcggagaaacaactccagttgaattacatgcacatgctggatcgaaaacaagcgacattacatatg

SEQ ID NO: 8222 - DNA, 157 bp, Bacillus thuringiensis
cgtgatatttatattattcgacgtacacgatacattattatatttccctgaaacagaaagacagggattagataatgttgtttgtacagtttggtatgcctacagggtataatgattatcttgcaagttataaagagattagtaatggattatggag

SEQ ID NO: 8223 - DNA, 253 bp, Bacillus thuringiensis
  unsure (1)...(253): unsure at all n locations
cgtgattttcgattagcgcttcggtccacacattttatgttgtccgaccagatacattccnacgggttgtggataacttatatgacaatgcgcaatactaagagcgtcctgtctttaaagtaccatctggttattcatgacattctctacaaaaaatgtcttgccttttaacccgggcaaaggcttcttcttacaccaaggataataaattttataattaacatactgaaaccatggaatacgacgcgcgtta

SEQ ID NO: 8224 - DNA, 343 bp, Bacillus thuringiensis
taaacctatcttatcaccctgcgaaactgcaaacccacggaggcgattttataaaactgtggggttcaataacctctctttatcaataccaattccgcccaactttgttgttacaaaactgcctaacaaactaacttctctaccttcgttaaaaagactaactgaacgctcaaactcatcttgctgtacatattcactctcgggaccaattaaatttacaatatagttctctaccgtgttacctatctatttgttctcagatgaaacatttttagacgtaaacacttgaacaacttatctcttacatactaaaaagctaccggctttaacctaatctactact

SEQ ID NO: 8225 - DNA, 165 bp, Bacillus thuringiensis
gatgatcaagattcttgccgctactgtatcaaagtcactgtaatcggaccgccctatgtggccggcacatgctggcgcagattcttatttagacaccatagcggtctcgcattctactggacgggctattaccacgttgtgacggtgagaaccctggggaaaccc

SEQ ID NO: 8226 - DNA, 273 bp, Bacillus thuringiensis
atcatatttcgcgtcgaactgtaaatatatataggatatacaactctcatattacttaagaacaaactcgattggaaatatttctaagcacacgatcgatatacacaaaaaattgatcatgaattaaaagtaaaacaaagactatctcataggcaacaatcctcacttatagacacatatactctcatttaaatatgcttataccaccacctcttcccatactgacatacaagttcccaggtgcacatataaacactccttgttagttgtcat

SEQ ID NO: 8227 - DNA, 378 bp, Bacillus thuringiensis
gccatctacttcccgatgacatacctcgatcattccaagcatagctagatcaaaaccacattcctcaatactatttcgaggtagctaaacttgactattcatctcaatgaaaaaatgcttaaagacctttgtataagtgataccgttctgactgacaggcgccacgtaacggtgattcgtatgtacgcgcttcactatggctgaaaccagagcgccagggattaaagacattcgccgtcccatgttcatatattaatactcttgggataccctcatgaattgcatattgagccgcgtttatattattgtgtccctcatatacgagatgccatataaaagtaatattagtgggagttcataattgtactgcaccttatt

SEQ ID NO: 8228 - DNA, 112 bp, Bacillus thuringiensis
accatttcaatataaagttgattctgatattgtgcaagatgcaagtggaagaatcaaaggcgcaatgcaaacatgtgaaaatagcattgagcaattattcttagaatgaatc

SEQ ID NO: 8229 - DNA, 459 bp, Bacillus thuringiensis
ttcctattttttaagcatgaggatgtatgtgcataatcgttaccgtttgaactagctgggtgctatgcaaaagatattgagtgggcaaaatgtacatattccattgagatgaatatacacgactatacgggcaggtgccaactggcgatagcagatagcggtcaatgaggctcaacaccggatactggcataaaaggggcaatgttgcaaggtacatctggtgaaaaactatctagagtgggagctgctaggagaccttcattcactggcgtagccatactctctttcacaccactgcatggaaggaacaacgaaagagggtgactacgatgggtaataaagaggcataccacgattgacaggcctgatatctgactggtcagatgataaaggccctaatttacacaatagagcttaaacgctagggaacgtgaacaatacagaatgtgagaagacaga

SEQ ID NO: 8230 - DNA, 282 bp, Bacillus thuringiensis
accatgaccataatgaactatggggggactttaaagcgaggtgcgataaaaagcaattgaaacagcactttatgagaaaaataatttgcccgttaatttttcaaaaacgcgagttgtacgtatcgagaaaccaagctggcgtaagcaattcatgctgaattaaatgcatgaaaaagacaaaccattttacgcaccaatcggattcaaaggtgaacgtggtgaacttaagggccgaataacatataaattaggtgatgtgctcggatcactaccttgagcatt

SEQ ID NO: 8231 - DNA, 114 bp, Bacillus thuringiensis
cgtgatgtcaaactgttcttattttacctttcattatttgttatcttacccctcttacttgactcaacgggggatggatttaaagggatttaggaaacctggcaagggattctt

SEQ ID NO: 8232 - DNA, 373 bp, Bacillus thuringiensis
  unsure (1)...(373): unsure at all n locations
aaaaaacacccccaaccgggaccccggggaagcaaaaacgcgcaancgccacaacaaaaaacggcgccacgacaaagcngaaaaaacacaacgcgcccgnnaaaaagacagaaaacgccgacccagcaaaaaacgcaaacgccccaaccggggccggaaaaacaaaaacaccccagaggcacaanaaanaganccccaaaaacacgacanagacaaanccaacggaaacaaaaaaccccaccaaaaagaaaaggaccccaaaaaagcgccccccaaccaaaggggcacannnacgcgccgccacgcgaaaaggggnnagccccaaaacaacacaagggagaacgaaaacccaccgaagagccaaaaacccgac

SEQ ID NO: 8233 - DNA, 431 bp, Bacillus thuringiensis
ggctcgaaaggtttgtcgccaatttcagatttttgagaggattttttttttggatattaggggggtggcctgggggttttttggatggagaacccaaaaaaaagctccttaaaaaaaaaaggaaccccgttggggtttattccgtatgctctttttaaagaggattttcctgttaaaaggttggttcattcaattaaaggaaaacccgaagagtttttatcttaaagttgagggccagggggccgtttccttacctgggtttttaaaaccaggtttgtaagaggtggaaggacaggtttccttccaaccggcaggagcgaagggtttgaaggaaaaaacggttttttataagctggctttaaaaattgcatttttcccagcattcccttttttaccttttgaatacccgggtttgtttttgggggcatttt

SEQ ID NO: 8234 - DNA, 201 bp, Bacillus thuringiensis
agatgcgtcattttggattcatgtatgttagccgacggcgtttactttgcgttaccggcatagatcggctgggtgattgaaaagagtgttacccattctaaaccctacgggagaccaccgatatacttaagcggacatgtggcaatagaggaggcttattgatatagaagcacttgagcctacagactggaagtacatccg

SEQ ID NO: 8235 - DNA, 208 bp, Bacillus thuringiensis
tgcttgctctgatgaacccattcaacaatttatgttatcagtagaccacagacttagggtggggtggagctgatataagacggaaccgcagccattgtatgacttccagcatgctccgtcatttcattcatcttgtcctatcgcctgactatcaccatataccatggctgcaccttgaataatcagctctgctcatactgcatgattt

SEQ ID NO: 8236 - DNA, 358 bp, Bacillus thuringiensis
ctctcgaactgaaacttaccttacaccgttcttatctgaatgctcaatatctatacactatgttggcgcttcataacctgattagaagataggacacagaccgttctttgactctgctggagctttaaaaattgatcgtctgactgcgagcctgcctttacgagaaaagtgtctttcttaaacatagactaacaacgtcctgagcgtacggcccatttaatatactatagaacctatcactcataagacgatctccaatatgatatatagtacgctaacataatacctttgttaagcacatacatatgtctgttacactctagccgaaaaatacgaagtctagcacaggatcagatac

SEQ ID NO: 8237 - DNA, 263 bp, Bacillus thuringiensis
catggattagtactaagggggatatggatagtaccagggactctgtaaaacgaaagagcgctgataaaaggcaataaacaattccgcccccaggaagtccctcagtcactgtgtcggtgcgggatattgagaaaggagacagtgcgggctcgagatactctaggcatggaaaccggactgatacagtacgctggaggaaatgcaggaacgcagccgtgaccgtatagaaagtataacctacgggacttatcgaccggcgagac

SEQ ID NO: 8238 - DNA, 335 bp, Bacillus thuringiensis
gcgagattaccaacatgcacggatgttttaaataacatgtatgtacctactgctggggccacaataaacacgggggctgtaaaagtgaatgtcccgcactgtagagcgagattgatcagttttccacgtagtgaatatgaaatatgagctatatcatgggtggaatcgaggcgtctgcctggctacgagtaagacacttgaccatggcacccggtgcattcgtttctcgataatgcttcagatccaggtcagatgacggaacagtatcaacacgatacgcaagcgtatgtactagaagctgagaagagtggaccagctcaaaatgcgcttgagaa

SEQ ID NO: 8239 - DNA, 477 bp, Bacillus thuringiensis
tgctctttctatggttgtcgtgctgtgcagtatcttgaagtatttggttgtagtcacattgccacatgccgttggactgcaggagccggccagcattttcattgatcaaagtgtcaatgcgctcccagacggctttcatttcttcgctccgccacaaggctttgaagtcttcgacctcgcgcacaccatcgcatgcggactgagagagtcgctgatgcaaagcctgaggagagttcggaatgccaatcgcagcagcagctttggggtgcacaattggtgcgagcggctccagtaggcgctctgggaggagcgtccgaagctggtggatctgccggggattagcttgctgagtaggtcagggcagagactaaacgagctaggaccaaccatttcttccagtttctgcagtttggcaagcgaggagaccagttgcagctccgtttccaggagctcagggtcgatgaccgtgtccacatc

SEQ ID NO: 8240 - DNA, 451 bp, Bacillus thuringiensis
acggacgttgcgcgggaggatatagcgagaaggtttttgctgaccactttgtatactgctgactacctgatggggagaccaccacatatactgtagtagactcttcatcataatgctaggcattagcacgcgaaccggtaactcatggattattccaagcactacatcgatcataatctaaatgtaggatatagccattatttaagcgcgcttagcgagcagtctgaacactataagaccaacagtcgtgaaccagacctcactcatgaataaaggcaacattggcacccggaaagtacatgatcgctataagatgccacccattcttagagacataattgatacatcgaacaaaactagaatgaccatattcttgccctgtacgcatcgggattgtgacccaagtgttgaagttaacaccataggatgcatgagactttatttctgaaac

SEQ ID NO: 8241 - DNA, 338 bp, Bacillus thuringiensis
tggatgattctcttaccacactatgatttaccatctttacaaacaattatacttcacggatacaataaataggaggtctttaaagcggaagcgcggaatactgaattttatcacatttcaaaacaattacattttgaatggttcggccgttattacctttagatattacattacacacggggtcttactggaacaccaaaatgtgtgcttactgcgcaaaactcacaagtgctgaaactattaaacaaaggaatgggtattaaagctcaaagatgtcgacaaatctatgcattctgttgacccttactgatgaactggaacatattactgaattttca

SEQ ID NO: 8242 - DNA, 118 bp, Bacillus thuringiensis
gtagcctatctgcatattgtttcctacacggtgatctcaaccacctgaccgaggatatacaagtggtgaatgttacggttcatgagggagctacccatctaaaatacggatgcgctag

SEQ ID NO: 8243 - DNA, 376 bp, Bacillus thuringiensis
gggtggaaaggttggcccccaatttaaaaaaaccccggggttcttaatgggggggcctacctcacataagggggggggttttaactccccgttggggataggaaaaccctgggggcccagttgattaaagaaatggcccaccccccgggggggggcgtttggcttttgggcccctttcccgtttcctggttcattaactcgttgccctgggccttccggttggggggggggttttcacttccctaaaggggggaaatccggttttccacaaaatagggggataccccagaaaaaaccttgggaccaaagggccacaaaagggccagaacccgaaaaaggcccgggttgttgcttttttcccataggcccccccccc

SEQ ID NO: 8244 - DNA, 551 bp, Bacillus thuringiensis
  unsure (1)...(551): unsure at all n locations
gcttcacgaccaggaagctagtatctactccattgttactgctcgaaggatgaatgattcgaacctcgatgagacaattcgctctattcgctgttctgaatgaattgtggcgctggaggggtcgtaatgtgctgtaagctgaacgcttatcggtgaggagaggcacccgcacagtacctgcatttgccttagtttaggcgtccaagggaatagcatttccacgggccgcaggctcaaacgggaaagtgtgtggtgcgcgcgttgcccgccaagatggggttagttcagtggcttgattccagaagcacttaaataagcgtttacgacgtcgtacaaccgaggagggacgaggaggacgaggaggagctcgcagcccccgcatttgatagacatttgacctcattctatgttaaaatccaacgaatgggatggcataatatagtatacttttcaggatcagactatgtaataagtctggagcgaagtgggctgagatccgcggcgtttcgagcccagtgcccagactaggcaatngaatggctttagcgatc

SEQ ID NO: 8245 - DNA, 503 bp, Bacillus thuringiensis
ctccatgtactcaatgcgtgcgtccgggcctgagccaatatgccgtggaagagtaatgatcgtgtctgttgcgccttccacaaacaccttttcacattctatatctctgccccttttgcagtagaccaagtggtaagtctcttcgtgctcgaatacccagtcgaccacattggggtcgttgcgcgtcaacgtctcacgttttctaacggggttctcagatccatcatcactacgcgtaaaaacaaaactgctggcaaactctccattgagagcaccctcatcgccgtcaaggacaatgaacccgtatgggtcatcgcccacatctgtctcatcagggcccgttgggtcctcgtcattggtgccatagttatctgtataccgatatatcacgtccttttcaataggattaggaaatatttttcccgagatcaaccggtaaatcctggttggtttggggtcacagcacacgcgatgtctgataccggggaaatagtagtcacatg

SEQ ID NO: 8246 - DNA, 435 bp, Bacillus thuringiensis
atatagcgctcgaaatagagaacaggcggggggatttacatgtgcacgtgataggtatggaacaccgggataggcattatactgaaaagctgtagctaaaccggatcaccagggactagcacgcttcatcacaccgagagggtgatcaatcacacactgtctgatacacagagcaaactactaccccaggcaacaaaacagatttagtcaaaccggtccaaagagcgacaggacaacaccagaccagtaaagaacgctcacctgctgtggagctacaatgttagataggcacatacgctctatgattaaacagaatggggcacagtacccaacccaacaggcaacagatgcaacgtgccaagctgatatgtcttacgtgaagtttagaagcggcattcacaacgaaagaacggaaagcgcgcgcgcaactctttt

SEQ ID NO: 8247 - DNA, 393 bp, Bacillus thuringiensis
caattgtaaaacttttttacgcataccgggtgatactgacttacggaattatagcaaaccataagtgcgattatatactgcacctacaagcggggttacaccctttatggaaataaagcctgcttcttgattaacatttgttgtaggtattataactggggactcatcccattgactaacggaacctacagcagcttttatgagtgcggtaacgagaggtaaatcaacacacacttattattgcggctgctataaatcgaacatactgacgctcgcgatgcaggtagatgtatggtgtgacagaaaattctccctgcacgtgctcagtaacggatcgaccttgggccgtttgatttataacagaactaataggggcccacttttaacttggtg

SEQ ID NO: 8248 - DNA, 271 bp, Bacillus thuringiensis
ccgccattactagtaaccatcattcattcttattctgggacggttgtcacggcaacgacggcggtaaacaaaccacatcgagagcttgcgcttggttcgcagtctatggagcttccgtctcataaaacactcctctagagtaacggcaccaatcgtgtttaccagctactgctagaaacggtaatgcactactccgtaaatccaatggtcaccgcctcggcaggtgtctccctatattgcatcagagtctaaactagctgccgcatcaatc

SEQ ID NO: 8249 - DNA, 465 bp, Bacillus thuringiensis
  unsure (1)...(465): unsure at all n locations
gaagaagggggagcattaggagaaaagggcgggcaccacccnccagagggaanggaagagagccaagcgacagaaccagaacagcaggaagaaaaaccacacggacacaaagacacgggaagacaagggcaagcaccagaccacccggaagccccgaaagaaggccgcgacaagacgaaacaacnacaaacacgcacaaaggacacacaggagcaccacacaacagaagcggcagaaaaagcagaaaaccaaaaaacacgagcagaaggcagccacgaacaacaggaacaagaagcacacgcgagacaacaaggggagcaaaaaacaccacccggcaacgaagacccacaagaaaagcgaaacgaaacgaangaaacgaaaacagaaacacaacgggggaaacaaaagccacaggccacaagacaaagacaccgggacccaaaaagaaaccgaaaagcaaaagcc

SEQ ID NO: 8250 - DNA, 499 bp, Bacillus thuringiensis
agatgcactaacttgattttggtaagccagcctcaattgcatagggcgtgtttgaagcgtcgacgcgaggaggaattgtcattgctggaaaacgacaatcacatctatgaggtctgacagacgttgctgttggttcacggagcgacacaggatacgaacaactggtaacaactgttaaggatgatgacactaatgagagagcgcccttacatatatcatatggcgctcactggcctgatggcattggagaaacctttgctgtctgagagacagaggaatacgagcatccgcgatgggaggcacttcagagtttaggcagctactacgctttctagatagtaacgaaggcattatcaatttataaggagctcatagccattcgagctcacttagaaggaaaacttgagtgaaccacagatgagcgcattacacaactcgtgacgtgtgtattgaaaggcaaaaaacagacgggatctggcatgaggacgagggaaaaaat

SEQ ID NO: 8251 - DNA, 344 bp, Bacillus thuringiensis
gcatttatggtcacaccgagacaacctgcgtcggtaatacagcgggcggacattactgctaacggggttgttgtaccgtccattacggtggcataaccactcatttttgtttccgaatacgcgcgatccgttgcatctacttgtgctatgtcatcacgagggatgctgcacgcttctactactgtacggtaggttctcttgaagatattacctaacgatatactctatgatgatgtcttttgaacttaatagcagctacatacgagacataaattactggtgcttgctaagcaagttactttaactcaccaccggctatgcctgctactctatcaactaagcgc

SEQ ID NO: 8252 - DNA, 446 bp, Bacillus thuringiensis
gagctcccctgggctggagaggttggtcgccaattccagaccatattggtaattttttgggggttcccaatttattttaacctgccgaattttccaggcgccgaagggggggaataaaggtgtggttgaattgggggattttctcatttatccggttcctttccttaacccggggttttttcttgccaaaaccgttttttttatggagggtctccttgggggacctttttttatccccggccttgaaccagaagataccgccccgaaaacaaaggcaaatccgggggtgggtttatttttggaaccattaaataggggggcttttggaccagaaccttccaaggttccgggggtttttttcccaggtaaaaaccctttctttaacactgttaatttccctttcaaatatcccccaatcgccgggggaccacctttaaagggtttgg

SEQ ID NO: 8253 - DNA, 121 bp, Bacillus thuringiensis
tagtttttaaagtttacattttattggttatggatattatacgtgttttgaaagcaaggcccgcggcctcaaacgtacatccgcccgagctcaacccaaccctagaccaccggcgcccccc

SEQ ID NO: 8254 - DNA, 167 bp, Bacillus thuringiensis
agagccaatatgccgtggaagagtaatgatcgtgtctgtggtgccttccacaaacacctaacaacatggggtgtgttttgcgaaagaacagttgcccaactggacaggtaatgggggctagaatgcccagccaatagcatggaggagggtccccaacacagcaccag

SEQ ID NO: 8255 - DNA, 406 bp, Bacillus thuringiensis
  unsure (1)...(406): unsure at all n locations
ataaaacngcttttccatanngttatgcactgatcttgtattagacatggtcattttttccgaaaaaattttcacaaattctcacaaaanagactttanttaatttttaattttaccctggcataatagatagtaactgaaaaacagaatgttaaacgtgggtgcagtaaatgaaacagtggcagacaaaagattacctcggtaaacagaaagcganttgattttcaagcccacacgcattgctcaattattcgaaaggcgttactggaacatgtgtcagagaacagatctggcagccagttggattaaaaccttaccgatttaaatattatatgaacattcatatttttaaccaatcgcttatcattttaaaaaggggccttctatcttctgagaattggctaag

SEQ ID NO: 8256 - DNA, 342 bp, Bacillus thuringiensis
aatctattattttcgatcctcgtcatactagtatctatataaaggtagagtgataagaaatctattaaacgtgattttttcgctggcatttgaatatggggctatttaattatcataatctaaaatatccaattttattttcagcaacatttaaacaattattgtccgatggacaaaatgggtattctattatattatctttaactgagaggaggattactattgaataaacgcggcatgacctcgagagtttgattattctctaattgtagatgttgtaatgaaaacattttggttaagaggatatgaaggatgttctacacaagatttatgcatttatac

SEQ ID NO: 8257 - DNA, 246 bp, Bacillus thuringiensis
gaaagcctttcccccaattccattttatcccccagttttggtatgtaccccccgaaaacccctcccgggcggggttcatattaaaaaggccgggccctaaaaaaagcccgttttcctgtctttttccaaaagcccccccccccccggccgggccccccaatacccccccctaactcccaaggggccacccccccccggccctttaaaggccccggcggtccccccttggtgcccccccataccccc

SEQ ID NO: 8258 - DNA, 393 bp, Bacillus thuringiensis
catctggcaggcgttttcgaatgagagtaactaatgtactgaatgactagtacattagtaatgggggggcattataccatagtgccgttgcgaatccaacccgctggggcataccagccactactggtgactgaggacacatgatcatatatgatagagcgggtactactaagctgaatgcgatcgctaatggcatttaattgctctgagctgattcaacgcggaactgagttgaatatctaaaccatatgcaacattttggatgactgggacgtgcaggaaatagagcgaatatctgaaacaccatactgacttaagcacttagtactcgtcctaacactcgtgctcttcccactcgggcgatcgtattgaccatcgatgtatatatgacct

SEQ ID NO: 8259 - DNA, 201 bp, Bacillus thuringiensis
  unsure (1)...(201): unsure at all n locations
tgccttattnnatagtagtcgctgaaaaaggggtctcccttgggggcttaacgcataaaaaagtttttgcgttattacaggatgcatggggcgttcactctagtaactacctctgtcattgatcggaacgcatgactctcatggagcactccatatgctatcgacagttctaaagaactacactggcattcacagctttga

SEQ ID NO: 8260 - DNA, 384 bp, Bacillus thuringiensis
gatacaataaaacaaattaaccattctttaatctttgtgtgcacaggatcacttatccctaattgggacattcgcaagagtaaaacgattccaacaaacacagcatacgaaattaacgagggccttaatgacacttcgttaaataaaaataaaccaatgggaatcctcattatttggattaggggccaacaacatggccaggtaataatctaattacgttaaaaatacaatctttaactattatataacagatgctataattgtcaattgattgtacaacagattcaaaaaatgaaccaaacaagtcctgttcaatcactgccatattatattatcctgaaaaacagagggctttacgactatttctttcaacacatcaaacac

SEQ ID NO: 8261 - DNA, 149 bp, Bacillus thuringiensis
tatgagagaaatggctcgacaccatctgcctctaattcattaccgaacagacgcgatattaaccgtacgttgcattccggctgagcaaaacgctagctggtatcctgattaatacgcgacctactaccatgcttaagatagtaccctaa

SEQ ID NO: 8262 - DNA, 155 bp, Bacillus thuringiensis
catatcagctcacgcgggggataatttgagactcgagtcgagtctatcaaagcggccaagcgtgtcacacacatgcggatgaagaaatgatataccgcgtgcattattaaggccagcctgcgactaagcgtggaaaacagtccagtgcagcctgc

SEQ ID NO: 8263 - DNA, 222 bp, Bacillus thuringiensis
cggcctgggagagtattgtgcggtactggacgagggaggagttgtggtcaggggagggtttgagctcgttgaatggggggattactaggcggaagagttgagatgcttatactggggttggatgactaagacggaaagagcttctgctggagctctgaggtgagaggtgagagggagacatggcatgcacagtcctctccattcactcttgggaccacatgt

SEQ ID NO: 8264 - DNA, 150 bp, Bacillus thuringiensis
cataaagaaatcacattaacagggggggatatagtaaaatacggcgcagacaaacaagagtataacttagctggaacaattcaagatatgtccagggaaaaccgggaaattgaaaggtccacgtaatgaaggccaaggagtaagaaggaa

SEQ ID NO: 8265 - DNA, 586 bp, Bacillus thuringiensis
  unsure (1)...(586): unsure at all n locations
gttccggtctcgcggcttactcaactacaattgttcatagaaaccaaggaggaaaaatattgaaagaagagctgaacatgtcttctattaatccccaagaggattccaggcccaatcctgaccaggagctggtccctatgtctaaagaaccttccacgtctactaccacgagcgctaggagtgaaggggcagaagctaggatgactgaggaggagaatgacgggaagaaagagacggagaagagaacggaaagctcaccggacgtgccaaaaaactctgaagatgaagtgaaagaggaccggagagtaaatctcggggtaagatactataatttccagggctttatgaatcgaactgtgggggacgactgggattatacgattgaagtctgcatcggccggcccaaccttctggaagagattcgtgaagaactcaggaggagagaagcaatcgagaagaagacatattccggcaatcacaggcctctgatggccgaatctccggaaaaaattggtgaaaaccgcaggttgcaccgngtgcgcataagatcgccaacagtgctcagtcatctcgaacgtctaacccg

SEQ ID NO: 8266 - DNA, 316 bp, Bacillus thuringiensis
cgggcgctagtgttctttggcaagtgtagcgaacacgctaaggcgggggactatacctggccgcctgtgtgaacagctgcattgtgaatgcctaaacaattatgtatctcttacgtaacacctcagatgtgtgcgtgggaccgaactaacgccatatgtgaggaaaggaacagctcgcagtacatacgctgatagccgcgtccaaggtgcaagagatgcccagggtccagatgaaataccatgcacacctaaacaagatgatcgttatgacatgtttcaacaagatggaatggccatacggagatttcaaagggct

SEQ ID NO: 8267 - DNA, 321 bp, Bacillus thuringiensis
cgagacctaaatctagcatgggatagttgaaaatggcaattttgcagaatctatattgcgcgattctttatgtcacagtacgtccgatgccgctatatagtgagactttcatcagtgcttgatttggtcaccccgactgatgccctgcctcagagaacagggctaaaagccggagaagaggaaaggcctccctctcctcttttcattgcctgctcaagcgcttatcaattgtttgaggctttctctctccagatatcaaaagccgctattatcattaagccaggacctactacagtaaatgagatcgtgccgataccacct

SEQ ID NO: 8268 - DNA, 358 bp, Bacillus thuringiensis
agacgcgtttcgtggcgagttcagagttcgggatgtaaagaaaaattatcggatgtacttaaaataacttattgcgccaaaagaagagagagatgcagagtggtgtgttagaagaagaacatgaagcgcatctaaatatacataagacactaacggagagccaattagcagataagaagcacgaacagaaagaaccaatcaccttaatttcgaaagtaaagcagagccccttaaggggaccgagaggggagcttaacgtatcacaccggtgagtgctatggggggggtgttcatgggaggagtgaaatgctataacgcgtccattagacgtagaaacaagtttttcgaaatgcgggag

SEQ ID NO: 8269 - DNA, 187 bp, Bacillus thuringiensis
attgcaagaaaaggaagaaccactgggggggatttactactctagggggggcctttcaaaaaaactcatcggaccgtcttaaatcttgccactggattaaaaataatgtctctaatcatacgctttaaatattttcgtcccgattaagctgctcatatccacgagtagtatattcaccttttcactt

SEQ ID NO: 8270 - DNA, 236 bp, Bacillus thuringiensis
caataactcatttccttatggaacaagcccaaaacaccaaaggaggcgccataaaaacagtagtcagcttaccaacccctcggataggacagcacacactattgagcgacgaagaacatactaaacagccatccactaaaaagaacgactcaaacacagttcatgtatcccaacctgaggaccaataactgctgcactcggcatactcataaacaaccgtgtaaccaacgacacca

SEQ ID NO: 8271 - DNA, 127 bp, Bacillus thuringiensis
tggtggattagacctttacgtgctgctttgcccttttttttagaagcagttttgcaagctcccctggggttttttagaccgctatgggggactaaagcttctaccgttttaacagtatatctcatgt

SEQ ID NO: 8272 - DNA, 264 bp, Bacillus thuringiensis
cgcccgcgctggtaccccccgaataagcaaaccatatcggtgtccacacttagaaagtatccggagtcttctaataactcgaacataggtactcagacctgccataagttgtttctcttacgctcattacattcacagcttcctacggtacattctaagacttaaattgccatgccaccattcacctccctgcgctttctcggaaccaatatattatatatccttcatcccatcctcacaactttctaatcatatcaaaagtta

SEQ ID NO: 8273 - DNA, 419 bp, Bacillus thuringiensis
tggttaatctcatccttggtgtgaaggtcaaagactaatggttcattccggcgaatcgtggagcaagtcaaatagctccctggagccacatgacgattcgcaacccaaagctgttttatgaaggtgggcacgtatgcggatgagcggccatcttccaagtagatcacagtagacagaccgtggaagagggcagagtcaagcacggtcgggtggagcaaatcctccattccgcctgatggcatctcgtactcgggaacgcgagcagtggcaacgcacgaatgcttgctgctacgaatttggtgcaagttgatgaaagggtgctgtcaatcaaggccggttcgtttggcaacggcatagaacttttgtggtatggtgccatgagggcactttgggtcgatacgagaaatatcagcaggcgt

SEQ ID NO: 8274 - DNA, 372 bp, Bacillus thuringiensis
tcgggattcgctgctgaaaataaaaaattggatgcaaaaccctcatgttatgcataatggctaaacatggcacgggggcaccacgaaagatcggtggaccccaagggggaccagtttctacactagccgggaacatataccagcaaaagtggataggacatttgacaccaattcgacgtaaaacagttgatggttatgacgaagctgtaaactagcaccgttacgcccacgcgataaacctggctaaaagcggacactccaagcaagggggccgggcataactggcatacgcaccctgtgggagcacttacagcctcagggagtagaaccgaacaacaagaagacgcaaaggctccatgtcctatatggaga

SEQ ID NO: 8275 - DNA, 513 bp, Bacillus thuringiensis
tcgtttttcgtctcggatttgtcgctgggcttttcttcgtcaaagaggccttccatggctgcagcacctcggcgcactctttcgtcaaaggtggctttgtcttgctctgtcatctcagtctctgccggctcgtcggccggttcctgctgtggctgaccggtcgtgtccttgatctcctgctctagctcagctagtgaagccgccaattgatcaaggtcaataacggagaatcttctctcaaagtcatccgtcgtgctgaaattccaatcctcatcaatatctgattcaacatctggcacttccgctgctgcagctccgccaggatgaaatagagaaatgcgttggcccccgcgctgggaccattggtagtatatgcggacgagctcgctcagggatgatgttgggtactcttcctcggaattcgcaatataggggtgtaataaaatatccgccattgatggtcgggtaaccggatctgaggtaaagcatatgctactagatctctcacaccct

SEQ ID NO: 8276 - DNA, 165 bp, Bacillus thuringiensis
gggggtgatactattttctactcctggtagtaatacaaaactgtttctctataaggctaatgtagaaactctggggggcttatacgatccccatagtagaccacacgggtggggaggccagctcgtcgacgctgtgctatacagtctatgcggagtggctgaatc

SEQ ID NO: 8277 - DNA, 190 bp, Bacillus thuringiensis
atactcccactttatagaccacatattggatttggagccctggggggcccatactaaattttgggggcactcccttccttatatgaaagaaaagcgaggagaagaggcacctccgcttgtactaacaagcgaaagaacatgatagtaagagaactgaatgacacctaaagaaacttggtgaccaaaaccg

SEQ ID NO: 8278 - DNA, 399 bp, Bacillus thuringiensis
ttatattctatactggacacttaacctgcacgggtttctttatgagatgcacataggtggatacagtgttctatcgtacgagtagagctgtaacaggagatctagacttatccaacttttaactgcatttattatatagtgcattatgacacgtttgagactgatacgatatgcgacgaggatctcgatcataactacaaccggggtgatcatgcgatatatatgttacgggtcatgatcgtcatatgaatctctgatctggattggaaaagaatatgctacattgtactttctgggcaacttgctttgcctttgcgcacaggccacactacttcatagcctacagtacaccgatcatgttagtgacctcatctgctcgttattagaaatgacaacact

SEQ ID NO: 8279 - DNA, 215 bp, Bacillus thuringiensis
gggaaaaacgcgtctggtcctgcacaacgaaaatatccataccccattaaaacctcataacaaatcattgccgcttcaataccctccttataggatcaacgctcccatacgtgttctgcccaaaatactgataaagaattacgttgtaattgatcaagccaagctactctccggaataaatataactctttttcattcggatgtcaccaaccagg

SEQ ID NO: 8280 - DNA, 430 bp, Bacillus thuringiensis
aactgcctctaataaactcgtacgaattcattgttggctttctagcagctctttggcagcgcgcaatcgctgctcctctgaaccctgcctacaagcaggacgagtttgagttctatatcgacgatcttagctgaaccctagttcttatccctcgggaatcctatgcatcgagaatggaccccgtaggtccatcggaggtagaggagtatcaacgcggctattgcggagggctactggaacgggacggaggatgtgctcgatgtgaaggagctgggcaagctaaagggcaaaggagacattggcgttcagaccgctcagcccgatgacattgcgcttgtcttgcacactagtggaacaactggcaagcccaaggctgtatgcgagcactttccgcaggagtctgattgggaactgtactaactcttgagac

SEQ ID NO: 8281 - DNA, 400 bp, Bacillus thuringiensis
ccctgagtgatctgctataacattacatttggtttgtatccaacgccagtaaatggatgatacactgatacttggatacaggtaaagcacaagcgactactcttgatacatcacgatactgcatgagtcgcgggtagttaacggactacatcctggcggtgatttcttttcttaaagggaggtccatttgacagccgtacatgcgtctgggtataccatgcgcgggaggggctactttttcctagctagtagatataccacatattttttgaaacaacggtatgaattcattcatggaccattgcgcacaggttttaatgacacctaaggctcgtttgtttactattatgtacacacgtggaactacaagtaatcctgcggaaagcccacactgaccttc

SEQ ID NO: 8282 - DNA, 480 bp, Bacillus thuringiensis
gcaatctagacgtcttcatatctgcctatctttattgttcgacttacctaactcccctccccccccaccctggctggccagacaaagctctcgaccttcagactagccgacgctatcgcgtcttatcattgtgctgcaggtcgagaatgctactccttccgaggcccgataagaacgatatgtcgggtgtcgaatgtcgatccttgtcccttgctgtgcacctggctcgggcaaaggtcaagctgttgacatgcgtcatgcaccatgggatctttagtttcatttaagctcttcacccctcactcggcacttgtgtctcctgacaatctgggctgagtctgattctggtgtcctgggaactctatacaatatggtcaacctcgagaagaccgcgatggccgctcaagcgaacgatgagcccgctgccgagcgagctgatatccagctgctagggattggatccctctcccttcgctttat

SEQ ID NO: 8283 - DNA, 194 bp, Bacillus thuringiensis
gagcacccagacaaccgggggcccattcgggaaaaaaacggcgcccaacccaaagaacaccaacagaccaaaacacgaggaaacagacgcacaagccagaacacggcgaaccacagacccaaagaaggccgcaaaacaagcaggcccacaagaccaccaaaaagacccccaacaggcgacgcaacaaagcccaa
